United States Patent 12,576,115 (BACTERIAL COMPOSITIONS FOR TREATING AND PREVENTING HALITOSIS) - sequence listing, part 12

SEQ ID NO: 26 - DNA, 4232566 bp, Bacillus subtilis (residues 1-2,116,283 of 4,232,566)
  source 1..4232566: mol_type = genomic DNA
tttatcaatatattttggcggttgtggcgaagtggttaacgcaccagattgtggctctggcattcgtgggttcgattcccatcaatcgccccaaataaaaattgcgggtgtagtttagtggtaaaacctcagccttccaagctgatgtcgtgggttcgattcccatcacccgctccatttctatatcgtcatgggcctgtagctcagctggttagagcgcacgcctgataagcgtgaggtcgatggttcgagtccattcaggcccaccatgacttttgtattccacagtagctcagtggtagagctatcggctgttaaccgatcggtcgcaggttcgaatcctgcctgtggagccaaatggagaagtactcaagtggctgaagaggcgcccctgctaagggtgtaggtcgtgtaagcggcgcgagggttcaaatccctccttctccgccatatgattacagatataataattttcggcccgttggtcaagcggttaagacaccgccctttcacggcggtaacacgggttcgaatcccgtacgggtcatccagaagccttgcatatcctgcaaggtttttttgttttttaaatcatgatatgtcttagattttgttctttattttaaaaacagactacaaaaatctccatatatttcgtttttcttcagaaaatgaagttaattgtctataagtataagcgctttcagcaaagggcttttttttatttcttcgaataaatactataaatgaaaactatgatgtcagaaaggatgattacatggccgctgccagcccgacagcacatgatgtttatctttttcacgaaggcagtctgtttaaaagctatcagctgtttggctcgcattaccgcgagctgaatggcaaaagcggatatgaattctgtgtgtgggcgcctcatgcgtcggaagtacgagtggctggagattttaacagctggtctggagaagagcatgtgatgcacagagtgaatgataatggtatttggacgttatttattccaggtataggagaaaaggaacgatataaatatgaaatcgtgacgaataacggtgagatcaggctgaaggcagatccatacgctatttattcagaagtcagaccaaacacagcgtcacttacttacaatttggaagggtacagctggcaagatcaaaaatggcaaaataaacagaaggctaagacgctgtatgaaaaacctgttttcatttatgaactgcatcttgggtcttggaagaagcattctgatggcaggcattattcctataaagaattaagtcagacgcttatcccttatatcaaggagcatgggtttacccatattgaactgcttccggtgtatgagcatccatatgatcgttcatggggataccaaggaacggggtattacagcccgacaagcaggtttggcacgccgcatgatctgatgaagtttgttgatgaatgtcatcaacaaaatatcggagtcattttggattgggtccccggacatttttgtaaagatgcacatggactctatatgtttgatggagaaccgctttatgaatacaaagaagaacgtgatcgggagaactggttatggggcacggcaaactttgacctgggaaaaccggaagttcatagttttttaatttcgaatgcgttgtactgggcggaattctatcatatagatggatttagggttgatgcagtggctaatatcttgtattggccaaatcaggatgaacgccacacgaatccatatgctgttgagtttttaaaaaaactcaatcaaaccatgagagaggcatatccccatgtgatgatgattgcggaagattctacagaatggcctcaagtgacaggtgccgttgaggaaggggggcttggttttcattataaatggaatatgggatggatgaatgacgtactgaaatacatggagacgccgcccgaagaaaggcggcattgtcatcagcttatctctttttcattactatatgcgtttagtgagcattttgtattgccgttttctcatgatgaagtcgtatacggaaaaaaatcacttcttaataaaatgcctggcgactactggcagaaatttgcccagtatcggcttttgctgggctatatgacagtgcatccaggaaagaaattgatctttatgggatcagagtttgcccaatttgatgaatggaaagatacagaacagcttgattggtttttggactccttccccatgcatcagaaagccagcgtttttacgcaagatcttctccgcttttaccaaaaaagcaaaatcctttacgagcatgaccatcgtgcacaatcgtttgaatggattgatgtccataatgacgaacaatcaatcttttcttttattcgttatggcaaaaagcacggtgaggcgcttgtcatcatttgtaattttacacccgtggtctatcatcaatatgatgttggagttcctttttttactcaatacattgaagtgcttaacagtgacagtgaaacatatggaggctcagggcaaatcaacaaaaagccgttatcggccaaaaagggagcacttcatcataaaccgtgttatatcacgatgaccatccccccttacggcatctcgattttacgggcggttaaaaaaagaggagagataaaaagatgaaaaaacaatgtgtagccatgctccttgccggcgggaagggcagccgtctcagcggattaacaaaaaatatggccaaaccggctgtatctttcgggggaaaatacaggattattgattttaccctaagcaactgttctaattcaggcatagacacagtcgggattttaacgcaatatcagccgcttgagctgaattcctatattgggatcggcagtgcatgggacctggatagatataatggcggcgtgacggttttacccccttatgccgagtcatcagaagtcaaatggtataaagggacggcaagcgccatttatgaaaatctcaattatttgaatcagtatgatcctgagtatgtactgattttatcaggagatcacatatacaagatggactacggcaaaatgcttgattatcacattgaaaagaaagcagatgtgaccatctctgtcatcgaagtgggctgggaggaagcaagccgattcggcatcatgaaggccaatccagatgggacgatcacacattttgatgaaaagcccaaattccctaagagcaatcttgcctcaatgggaatttatatattcaattggccgcttttgaaacagtatcttgagatggacgatcaaaacccttattctagccacgacttcggcaaagacattattcctctgcttttggaagagaaaaagaagctttctgcttatccgttcaagggatattggaaggatgtcggaacggtgcagagcttgtgggaagccaatatggatttgttaaaagaggactcggagctgaagctgtttgaacgcaaatggaaaatttactccgtcaatccaaatcagcctccgcaatttatttcatctgatgcgcaggttcaagattcgcttgtgaacgaaggttgtgttgtatatggaaatgtgtctcactccgttctttttcaaggtgtgactgttggtaagcatacgactgttacatcatccgtcataatgccggatgtgacgattggggagcatgtagtcattgaaaatgccattgttcctaatgggatggtgctgccggatggcgcagtgattcgctccgaaaaagacattgaagaggtgctgctcgtttcagaggaatttgtagaaaaagaattgatttaattactgaagagggggcagagtcagtgttcaataatcaaatgttaggtgttatagatgaaaccacatataagcattctcttcaggatttaacagcacagcggtcgctcggggcgatcccttttgccggcaggtaccgactgattgattttatgctttccaacatggtgaatgcggatattaggagtgttgcaatttttccgaagtatcgttaccgttcgctcatggatcaccttggggcgggtaaggaatgggatttgcaccggaaaaaggacggcctcttttttttcccgtctccccatcttcatcacgaatacgatgaattcggttcctttcgccagttttcggaccatctagattacttccacagaagcactcagcaatatgctgtaatctccaacagccataccgtatgcaacattcaatttcaatatgtgctgaaacgccatcaggaggttggctgcgacgtcaccgaggtatttcaggacggccagtcgctgcaaatctatatcatgtcaacaacgcttttaaaggatctgatctacggacatagcgaaaaaggctataaaaccattcaggaggctgttgaaaaggaatcttccgccctgaccatttgcccttatgaatattcaggttatgccgctgtcattgattcggtggaaaaatattatacccacagtatggagctcattcagcctcgtttttggcagcaggtgtttttgccgcagcagcctatctatacaaaagtgaaggatgagccgcctacgaaatacggaaagcacagcactgtcaaaaattctttggtggcaaacggctgtgtgcttgaaggagaggttgaaaactgcattttgttcagggcggtccatgtcggaaagggtacgaagctgaaaaactgtattattatgcaaaaaacgcagattggcgaggattgtcttcttgagcaggtcatttcggataaggacgttaaaatcggcaaggcgacggaagctgtaggaacagctgagcagccgcttgtattaagaaaaggtttggtgcaaggagagctgatgaattcttgaagatattatttgctgtgtcagaatgcaccccatttgtgaaatcaggaggtcttgccgatgtagcaggtgctctgccaaaggcgcttgcgcgattaggcaatgaggtagctgtgatgctgccgaagtacagccaaatacctgaaccgtggaaaaagcgtatgaaaaaacaggctgagtgtaccgtagctgtcggctggcggcagcaatattgcggaattgaacatatggcagagaatgatgtgaattattacttcatcgacaatgagtactatttcaacagggattcgttgtacgggcattatgatgacggtgagcggtttgcctttttttcaagagctgtgctggaggctgccaaagttgtgaatgttcaagccgatattgttcatactcacgattggcatacagcgatggtcaattatttgctgaaagaggagtacagaaaacatcctttttatgaacggatgaaaagcgtgctcacgatccacaacctgcagtttcaaggcatattccctcctgatgtcacacatgacttgctgggtcttgagatggatcattttcattatgaaaggttagaatgcaacggatttgttaattttatgaaggcgggcatcattgcggctgatcatgtgacaactgtgagtcccacttacagaaatgaaatattgacgccgtattatggtgagcagctggagcaggttttgcaatatagggaaaatgatgtaaccggcatattaaatggcattgatgatacgttctatcagccgaaaagcgacccttatatagaggcgcaatacgattcaggggatcttgcatgcaagttggaaaacaaaacgaagcttcagcggcggatggggcttccagagaaaaacgatattccgctgatcagtatggtgacaaggctcactaaacaaaaggggcttgatcttgtccgcagaattatgcacgaacttcttgaggagcaagacatacagctggttgtgctgggcacaggagaacgtgaatttgaagattatttccggtatgcagaatttgcttttcatgagaagtgccgggcttatatcgggtttgatgagccgctagcccatcaaatttatgcgggctctgatatgtttttgatgccgtcgaaatttgagccgtgcggtttggggcagctcattgctcttcaatatggcgccattccgattgtcagggaaacgggcggtctttacgacactgtccgttcctatcaggaggaagagggaacgggcaatggttttacgttttccgcctttaatgcgcatgatttgaaatttacgattgaacgagcgctggcgttttatcgccaacaggatgtatggaagagcatcgtgaagaccgcaatgaatgcagattacagctgggggaagtcggctaaagagtatcagcgtattttcgagcaggtgacaaggagtggacgggatgttctcgagtaaagaacgctttgcagacttatttttaaagcgtctggaaatgacgtgcggaaaaagctttaaagattctgccaagctggatcaatataaaacgttgggcaatatggtcagagagtatatcagcgctgattggatcgaaacgaatgaaaaaagcagatcaaattccgggaagcagacatattatttatcaatcgaatttctgctcggtcagctccttgagcaaaacttaatgaatcttggtgttcgtgatgttgtagaagctggtttaaaggaaatcggcatcaatttagaggaaatccttcagatagagaacgatgcaggtctcggcaacggcgggcttggccgcttggccgcttgctttttagattctcttgcttcgttgaacctgcctgggcacggcatgggcatacgttataagcatggtttgtttgagcaaaaaattgtagacgggcatcaggtggagctgcctgagcaatggctgaaaaacgggaacgtatgggaagtaaggaatgcggatcaagcagtggacgtgccgttttggggcaaagtccatatgacagaaaaaagcgggcgcctgcattttcgccacgaacaagcgacaattgttaccgctgttccttatgatatcccgatcatcggctatgaaacgggcactgtcaacacgttaaggctttggaacgccgagccctatgcgcattatcacggcggtaatattttgtcttataagcgagaaacagaagcggtttctgaattcttatatcccgatgacacccatgatgaggggaaaattttacggctgaagcagcagtattttttagtatgcgcaagcttaaaaagcattgtgaacaattaccgtaaaacacataaatctttatccggcctgcataaaaaagtgagcattcatattaatgacactcaccctgcgcttgcggtgcctgagctgatgcggattttgctcgatgaagagaacatgggctgggaagaagcttggcatatcactgtacatacgatttcttatacaaatcatacaacattgtcagaagcgctcgagaaatggccgattcatttgtttaagccgctgctcccgcgaatgtacatgattattgaagagatcaatgagaggttttgccgtgcagtttgggaaaagtatcctggagactggaaaaggatagaggacatggcgattacagcgcatggtgttgtcaaaatggctcatctggccatagtaggcagctacagtgtaaatggcgttgcaaaaatacattccgatatattaaaggaaagggagatgcgcgactttcacctgctgttcccgaatcgttttaacaataagacgaatggaattgcccacaggcgctggctgttaaaagcgaatccaggcttgtctgccatcattacagaggcgatcggtgatgaatgggtcaagcagccggaatcgctgatccgtttagaaccgtacgcctctgatcctgcatttattgaacagtttcaaaacaacaaaagcaagaaaaaacaagagcttgccgatttgattttttgcacggccggggtggttgtgaaccctgagagcatattcgacgtacaggtgaaacggcttcatgcatataaacggcagctgttgaatgttcttcacattatgtatttgtataaccgcctcaaggaggattcggggttttcaatctacccgcaaacctttattttcggggcaaaggcttcaccaagctattattatgccaagaaaatcattaagctgatccattctgtcgcagaaaaagtcaattacgatccagcggtcaaacagctgatcaaagttgtttttttagaaaattatagagtttctatggctgagcgaatttttccggcatcagacgtaagtgagcaaatttcaactgcaagcaaggaagcgtctggtacagggaatatgaagtttatgatgaacggggctttgacgatcggcacgcatgacggcgcaaatatcgagatctttgagcgggtgggccctgactgtatttacacgttcggcttaaaggcggatgaggttctatcgtatcaggaaaatggtggctatagatcgagggaatattatcagcatgacagaagaatcaggcaggtagcggatcagctgatcaatggtttttttgaaggagaagcagatgaatttgaatcgatctttgactcgctgcttccgcataatgatgagtattttgtgctgaaggatttcagctcatatgcagatgcgcaggagcgaattcaagctgattatcgagagcgaaggaaatggtctgagcgttcgattgtaaacattgctcattcaggatatttctccagcgaccgcacgatccgggaatatgcgaaggacatttggggcatcaagccgatgatgtgaaaaagccgctgtataagcggctttttttgttcacagatccattgaattgattgtaaaggataagaacgtcgcaaatgcactccataaaaaataaggcaaaagaagatagcttgcggctctgctgtattttttggcaatgatcagtaatacgattgctgtgatggcgacaagcaggcagtcaagcgatgcagccagcagatttttttgcgtaaactggaaatagctgaaggcttgattgagcacgtaatttatcaaaagtgtaaaccaaaagcttttcgcacctttaaatgaaaacgcagcatatacaatggctgctgaaagggagatcagggcaaacaggatggcccaaatgatgccgatcgcagttccgcttggcgtccagtccggttttttcaatgaattgtaccattcttggtccacaggaaacaggtagcctgcggctgaaaacagcgcatatgtaatcacaaaaacggctaaagcgccgacaatctttttcatatttgcaacctccgcatgtatttaattaccctttatcttataaagatcaaacccccgatatgcgggggaaatgatggtcttaaataagctgccgcaatgcgtttgctttaatgcgttcatattcaaaagctgattctaattcttccttcggtaaagcagacttgcggacgtatttttcgcgaatgacatcgtaaagctcgtaaggaaacagcatatcaataaacatgacttgtttttgttcttcagttaatggggctctggattcgtatgcgttcagcatgacatgaaatgtttcttcatcccaaacgcccgtcgtatccaaaagcggaataatcattttgcgcaaatcgcgaataggcagatcaaatgaaacggtatctaagtcaatgacccaaatctgttcattttcccctaagagtgtatttccggttccgtaatcctggtggcaaaggttagggctttttttcagctgttcagtccatggaacataggtcgactgcaaaagctggtctttgatgcgcagcccgtcttcaataaagccatctatctcctgaagataaaactgtgagaaaggatcttctttttccgcctccgccatcagcttccacgtttccatctgtttgcatcgtttcgtgtagtgattcggccagcgacctaatttggtaaatacgggaacgccatttggcggctgatatccgacggaagctgtatgaaaatcagcaaggcctttcatgataaactccaagtcctgctttacagtcagctcaaacggccttccttcgatccagtcatatacgacaaatagaaatgagccgtgcttggaatataggctgccttttttgtttgggagtatgccaggaacattcatgcctttttttgctaaatagtcctgcgcgaaaatggaaaacaacgctttcttttctggcctgtgtattcgttttagacaaaccgcgccggagtctgtgtggaccttccagacaagcgccatctggtttccctgaatgacgtctattttttcagcctgcacatcccatccttgaagcacattttcagccagctccgttaatttttttgcatcttctgctgataaaggaagctctgatgaattcccctcctcaatgacttcatggttttctgccattaaaggacacatccttacctgttttactcctaccttatgaatcaaaaggaaaaaatgattgagttatttgactatatttaatagatgaatctggttgtttacccgttttgtttttagggcagtcccattccgcacaagttggttgttcagccgtatcatgattctaactagttaaaaatcatgcaggaatggaggctatgtatgaaaatagcactgatcgccacagagaagcttcctgtcccatcggttcgaggaggcgccattcaaatctacctagaagcggttgcccctttaattgccaaaaaacatgaggtgactgtgttttctattaaagatccgaatctcgctgatagagagaaggtagacggtgtccattatgtgcatttggatgaagaccgttatgaagaagccgttggagcagagctgaaaaagagccgttttgatcttgtgcatgtttgtaatcgcccaagctgggttccgaaattgaagaaacaggcgccggatgctgtttttattttaagcgttcacaatgaaatgttcgcttacgataaaatcagccaggcggaaggcgagatttgcatcgactccgtagcgcagattgttacggtcagcgattatatcggacagacgatcacaagccgttttccgtcagcacgatcaaaaacaaaaacggtgtattctggtgtggatttaaaaacgtaccaccctcgctggacgaatgaagggcagcgggctcgcgaagagatgcgtagcgagctggggcttcacggcaaaaaaatcgtcttgtttgtcggccggcttagcaaagtcaaaggcccgcacatattattgcaagctttgccggacatcattgaggagcaccccgatgtcatgatggtgtttatcgggtcaaaatggttcggagataatgaattaaataactatgtcaaacatcttcatacccttggtgcgatgcaaaaggatcatgtcacatttattcaatttgtgaagccaaaggacattccgcgcctttataccatgtcagatgtatttgtatgctcttcgcaatggcaggagcctttagcaagggtgcattatgaagcgatggctgcgggacttcctattattacaagcaatcggggaggcaatccagaggtcatagaggaagggaaaaacggctacatcattcatgactttgaaaatcctaaacaatatgccgaacgtatcaatgatttgctgagcagctcggaaaagcgggaacggcttgggaaatacagccgccgtgaggcagaaagcaattttggctggcagagggtggctgaaaatctgctcagcgtctatgaaaagaacagatagaaggggtgaacagagtgtaccaaaaagagcatgaagaacagattgtgtccgaaattctcagttattatccgtttcatatcgaccatgtggcgctgaaatcgaacaaaagcgggcgcaaaatctgggaagtcgaaactgatcatggtccaaagctgctaaaagaagcgcaaatgaaaccggagcggatgctttttatcactcaggcacacgcccatttacaagagaaagggctgccgatagcgccgattcatcaaacaaaaaatggcggtagctgcttgggcacggatcaggtttcttacagcttatatgacaaagtgacaggaaaagaaatgatttactatgatgcagagcaaatgaaaaaagtcatgtcatttgccggccattttcatcatgcctcaaaaggatatgtttgcacagatgaaagcaagaagagaagcaggctgggaaaatggcataaattgtaccgatggaagctgcaggaacttgaagggaatatgcagatcgcggcatcctatcctgatgacgtattttcgcaaactttcttaaaacatgctgataaaatgctggcaagaggaaaagaagctctcagagcgcttgatgactcagaatacgaaacctggacaaaagagacgctcgagcatggcggattctgttttcaggattttacattggcacgtttgactgagatcgaaggggagccttttttaaaggagcttcactcgattacctacgatttgccgtcaagagaccttcgtattctgctgaataaagtgatggttaagctttctgtatgggatactgatttcatggttgcactgcttgcggcctacgacgcagtgtatccgctcacagaaaaacagtacgaggtactttggattgatctcgcgtttccgcatttgttctgtgcaatcgggcacaaatattatttgaagcaaaagaaaacatggtcagatgagaagtataactgggcgctgcaaaacatgatttctgttgaagaatctaaagattcgtttttggataaactgccggaactgtataaaaagataaaagcgtatcgggaggcgaattgacatgaggtcatcgagacaaaaagcctctatttctaaactggatctcgaccaattcgtatttacaccgcctggaccgatggggtggcaggctcatgactcaatgtcagctgagaaggaagaagaggagaagcatttagatgtgggcagcattcgagagctccctcacatcaatgcaccgaaagaatatcaaaaagaaacgaaggaaaaggaaacagatcacaaaatcgtcgatgatgaagaagaaacaaaattcgaaaccactctggagcctgaggaggagcgtgattcgaaacgctcagcgcccccatatgaagaagaggatgaagatgaagaaccagacttagcggaagaagctaaagtggaaatcatcattcttccaagtgaatctaaaccagctccatggttttctcaaactgtaaagcgcaaggcataaagtcacatttatgcctttttttaagttctctgtagcgaaaaaacagcccgttttgcaacacgagctgtaggttttatgtttttgctttcacaaaaagctgattgatagatgataaatcaaaattttgcgtcagaaaaggcggcggaaattgtttgtttttcggggtcagaaaggattggtaaacagtattgagccttttggcagcatgggtaaaggtaaataaagcttctacatgctttcgggcgttttttgtcattttgttcattaattcttgatctgtaaaggctctgtcaattgcttttgcaaatgaagaaggtttgttgtagctatcgatgacaaggccggtgacttcgtgttttacgacttcaccgtttccgccccggtttgtggtaattaagggcgtgccggccgccattgcttcataattcacacgggcgaggggttcgttccactgagagctgcacacaaatacatctgccatcagaaaaaggtttgggatgtcgtctgcgggaatgaattttgtaaagattatgtggtctctgtatggcagcgccagcgtgcgcagataggtgacatattggttttcgctgtcatcgctgaaccacttcccgcctgctatgaccagtacagcatcagggtgctgctgcaaaatccgtctcatgctgtgaatgagaaggtgaggcccttttgtcgggcttaagcggccggcgaataaaataacttttttatcttcaataccgtattttttccggtatgtttttctgacagccgagcctttcatcgtccagacgggcggataagagtttaaatcaacgccggaatacacaacttttgtgatgtcctcggcttcagggaaacgttcaatgacggtttgtttaataaattcgctcactgttgtgatcatggagacattgtcgagtacttcttttccttgcgcgaaggtcatctttttttcagaaaacatttcgttatgcaggctcagaacgatcttgctgtttggtgaggcttttttatataaagagacatttaaaggcctgttgaacacatgaatgaggtcaaaggaagaggctcgcagctcttcggctaccgcctcgcggtaatgttcttttggcagatggatataatgtacgccgtcttttgtttctctttttggaagcgctggatcttctattgaaaaaatggtcaggtcgtacctgctgctgaaatagggcgtgacaccgtcaatcatcatttgaatagcgccgccgcgtactgcgggcgccggcagcttttctgtacagataaaggcaagcttcatttttattccccctgatacagcgacgataaataggcgatttcgttggtcaagccatcctttaaggatgtggcgggattataatgcaagagctgttttgcttttgaaatatccgcccacgtattgctcggttcgcctgctattttgtccgaaaagtgcagtgttgcttttctaccggaaatatcctcaatgagggagacaacctttaagactgaggcacgctctgcgccgccgatatttaatgtttcaccaataaggtggggtttcccaagaacagcggtgatgcctttgacacagtcgccgatataagtgaaatctcttgactgctgcccgtcaccgaagatggtaagcggcttttgctgaaggtgctgcttaatgagccggtgaaaagccatatccggccgctgtcttggcccgtatacggtaaaaaaacggagaatcacaattggaatgccaaagctctgttgatacacatggcaaagcttttctcccgtaagctttgttaccccgtacggagataaaggagaaagcgacgtgttttcgctgacttttccttgtttttcgccatagacggaagaggtggatgcaaagacgaacgtttgaatagaatgttcccggcacgcctcgaggagcctttggagcgcttggatattatgtgcggcatatgggtgaaaatgattgccccagcttgagcggacacccggtatggccgccaaatgaaagatgacgtccactccttccagtaagggagcaagatcggctgtcagcagattttcctttatgaacgtaaatcgcttttccggcagcaggtttttaaggttttttaatttcaaggaaaatggagtaggaccgataaagtcatcgattccgataacgttatgtttcttatcttttagtaattcttcgcagaggtgggagccgataaagcccgctgctcctgtgacgagtattttcatggacggccaactcccgtacagatcaggccgcaagcctcgatcagttctttttttagtacgttgcgtccgtcaatcacaagacgccctttcatgatatctgcagcctttttccaatcaaacgctaaaaactcaggccattctgtcgccaaaaataaaaagtcactctcttcgatcgcatcaaaagcttgagaatgctgagttacatgttgccgcaaatgttctggaagtacagcttcaggatcatatgcatgaacatcacatcccagctccgccagcctttccatcagtctgacagcctgagaattccggatgtcatcagtattcggtttgaaggaaatgccgagtacagccgctttcttgccttgaagtgtttcgaagaatgactgtatttttttgatatacaggccaagctgggtgtcattaatgtgctgcacggcccggagcaggaaggtctccgtgtttttttcctgggcagcaaattgcagcgcctgcagatcctttggaaaacaagagcctccgtatccgatgcctgcctgcaaaaagtgcttcccgatccttgggtctagaccgatagcgcgggaaatatctgagatatctgattgataggcttcacatatgcgggccatttcgttaataaacgaaattttggccgctaaaaagaaattgttggcatatttgatcagctctgctcccgctaagcttgtaacgataaaaggggtatcaatgtgtttgtaaatggatttgacgatggctgccgatacgtgatcttcttcctgaacaccgatgactgttttgtcaggatgcagcatgtcatataaggcattgccttcccgcagaaactccggattggatacgatattaaagaggtttttagacactccggaggcaatcagctgttttgctatgttttcatttgtcccgggcggaacagtgcttttcgtaataatggttttatacgatcggattgcctcgcttaaatcaccgatgacggactgcagggctttcgtatcagctgatccgtccgaacgcggcggagttccgactgcgataaaaataacgggacattcctccatgctcgatttcacttcagaagaaaacgagagattgccgcaacgaagtattgcatctgaaagcccaggctcgtaaaagggaatgactccttttttcagctgcccgatttttttgacgtctttgtctgtgcatatcatgtcatgtccgatggatgccagtgccgctgatagggttaaaccgacatacccggcgccaaccacacaaattttcatcacctgagctcctttacaagattactggtcatatatcaatatcctattaaaaaagggctggttcgtgattccgctttctgcccagttgcttccgcctaatttcagatgtacaaacatcgggatgcgctcttggaatatcatgtaataaacatgagctgaggggaaaataccatgataaaaaaagcgatcattcctgcaggcggattcggcacgagaaatctgccggtgacgaaggtgattccgaaagaaatgtttccggtaggatctaagcctgtgattcattatcttgttgaagaattaaaggagtcaggcattgaggacattttgatggttgtatcgagccataaaaatctgattgtcgactattttgattcctctttggcacttgaggcttttttggcctctaagaataaactgcatttacttagagagcatcccattccggatatacggattcactatgtgcggcagccttatgcaaagggtcttggcgacgccatttctttcggaaagcaatttgcaggcggagagccttttgccgtcgttttgccagatgatctgattttttccgccaatcagccggctttggggcagctgattgaagcatatacgaaatatcagtccagtgtgatcggcttaaaagaaacaaaaacggaggatttacatcattacggggtgataaaaggggaacctgttgaaaaagggctttatcgcatacaggatattgtggaaaagcctaaacaaaaccctccgtctcattttgccgcagcagggcgttatattttcacaccggatatttttaatgagctggaggcattagaagctgacagcggaggagaagtgcaggtaacggatgcgataaaagcttcgctcggggcatgtaccgtatacgggaaattgctagagggcgagcggtatgacatcggcctgcaaaaggattatctgaagctgatttacgatatgctgaaaacggaaaagaacccccaataattgggggttcaatcagcgtggagatcgccgaatgtggtcatgattccctcttcgtcaagttcttcttcatagcgctcatgggctctgctttgataaacggtaatttcttttccagtgatatctgtagcgatgaaattttcgtaagactccgtattgccgatattctcttcggcattcatcgtcatatcatcatagctgagcggagggttttccatatcctgcggcgtttgtgagttaccatatttttcgacatcctgataggaatcctcactgtcatatggcgctctgatttcttcatcatcatcaaattcaaattgcccgaatggtgtttcttcttcaatcggacggtctctggaaaccacgtcctgtgacgaatactccgcgagggttgtggcagtcggaagcgcttcaagtcgttcgaaagggatttcctttccgctgacttcacaaatgccatacgtaccgttttctatcgccttcaatgaatgctcaatgtcccgaaggtgctctctctcatgcaagtctagagcgatgtctttctcacgctcgtaaagttctgtcgcctgatcgccgggatggttgtcgtatgccgaaagctcaccccacgaatcataaggaaaggctgagttaagctgaaaatgatcattgtctttgaaacggtttaagatatcttttttcgtttgttccagttcattttttaaatgctgaagctgttctttcgtaagcaatgtgatcgcctcgtttctctgtgatgcatacctttagtatgaacagatcgcctgagaactttcataaatggcgggtggaggaatataggaggttttccttttatggtaagcggatacaacctttgctatcagtggagaaagaaatttaagctttgtttctttttcatttctgaaattaggtttataataggtaaggcaggccatttggactgcatgatctgtgtttgacacaaaggagacacaggtgtatggtattaaaagcattttaaggattatggaggaatgtctcatggtgacaacggtgcagcgtacgttccgaaaggaagttctacatgcattacataaagccaaagaagtcaaccatgctgtcttaataagctattcgagacaaatcgagtctcttgaccctctatcatttttcaattacggagcaaaaaaatatacaggcaatcgatttttttggtcagatcctgaaagtgaattgacaatagtcggtcttggcaaagaagcggttttccagacaaatcaaaaaaacagcgagcggtatcgtgaggtttttgaacaatgggagcgctttaaaaagacggcttttcatatttatgaagaagaaaagctgcagcattctgcagtgggacctgtgttattcggaggattttcttttgacccttgcgaagaaagaggttcacaatgggaccatttctcggaaggggatttctttgtgcctgcgcttatgctgacgatgacggctgaaggcccgttcttaacagttaacagatgggtaagcggaggagaagacgcagaagctgttttagaaagcttaaaagcttttgcggcggaatttatggttcccgatttcaagcaagaagatcaggctgtgattgcagcagccgaagagctggataaggatgattggctgaaagcaatcgaaacggccacaagccaaattaaagagaaacaatatgataaggttgttcttgcccgagagctgctgctcacgtttgacggtccaatccaaattgaaccggtgcttaaaacgcttctggacgatcagcagacaagctatgtttttgcaattgaacaagaaggcaaaacctttgtcggcgcgtctccggaaagactgatcaaaagagacggcggcactgtcatgtcttcctgtctggcaggctccattaaacgaggcgtgaatgaagaagacgaccgccggataggccttgaattattaaacgatgagaaaaacctgcttgagcatgatattgtggtaggtatgattcataatgcttttgtatcaagctgttcagaggttgaaaagcctgatggacctgttttgtacaaaacaaaaagcgttcagcacctgtttacgccgattgtcggacagctgcgcgagtctgcttcaatttttgacttaattgagaagctgcatcccactccggcgctcgggggagcacctcaggaaaaagctgttgacgtgatcaggaagattgaaccgatgtctcgcggctggtatgctgcccctatcggctggattgacagccaggataacggggaattcgcggtagccattcgttcagggctgatcgaaggaagcactgcaaggctgtttgccgggtgcggtattgtggaagactcggaaccaatctcggaatatgaagaaacacagattaaattgaagccgatgatctctgcattaggaggtgagaggcgttgacagtcaacccgattactcattacatcggaagttttattgatgaattcgccctttccggaattacggacgccgtcgtttgtccgggctcaagatctacaccgctggctgttctttgtgctgcgcatcccgatatcagcgtccatgtccaaattgatgaaagatctgccgggttttttgccttaggtttggcaaaagcgaagcagcgtcccgtactattgatctgtacatctggaacagccgcggccaacttttatccggctgtggttgaagcccattattcaagggtgcctattattgtgttaactgctgatcggcctcatgagctgcgcgaagtaggcgcaccgcaggctattaatcagcacttcttattcggtaactttgttaagtttttcacagactctgctcttcctgaagagtctccgcaaatgctgagatacatccgaacgctggcaagccgcgctgccggagaagcacaaaagcgcccgatggggcctgtccatgtgaatgtgccgctgcgcgaaccgctgatgccggatctttcagatgagccgtttggaagaatgagaacaggccgtcatgtgtctgtgaaaacgggtacgcagtctgttgaccgagagtccctgtctgatgtggctgagatgctcgcagaggctgaaaaaggaatgatcgtctgcggggagctccatagtgatgcggataaggaaaacattattgcgctgtcaaaagcgcttcagtatccaattttagcggatccgctgtctaatctgcggaatggtgttcatgataaaagcactgttattgatgcgtatgattcgtttttaaaagatgatgagctgaagcggaaacttcgtcctgatgttgtcattcggtttggaccgatgcctgtttcaaaaccggttttcttatggcttaaggatgatcctgcgattcagcaaatagtgattgacgaggatggagggtggagagacccgacacaggcaagcgcgcatatgattcattgtaatgcgtctgtttttgctgaggagatcatgggaggccttactgctgctgccagatcctcagagtggctggaaaagtggcagtttgtcaatgggcggttccgcgagcatctgcaaacaatcagcagtgaagatgtttcgtttgaaggcaatctctatcgaatccttcagcatcttgtgcctgaaaacagctcgctgtttgtgggaaacagcatgccgatcagggatgttgatacgtttttcgaaaagcaggaccgccctttccggatttattcaaaccggggagcaaacgggatagacggtgtcgtctcctctgccatgggggtatgtgaaggaacaaaagcgcctgttacccttgtgattggagatttatctttttatcacgatttaaacggcctgctggcggccaaaaagctgggtattcctcttactgtgattcttgtcaataatgacggaggagggattttctcctttttgccgcaggcttctgagaagacacactttgaagatttgttcggcacaccgacagggctcgatttcaagcatgcggctgcactttacggcggaacgtattcatgcccggcttcttgggatgaattcaaaacagcttacgcgccgcaggcagacaagcccggactccatttgattgaaatcaaaacggatcgccaatcaagagtccagcttcatcgcgatatgctgaatgaggctatgcgggaagtgaaaaaacaatgggaactgtaaacataacggtacaagatggtgtccgatatgcagtggcagacgaggggccgaatgcttccgaagccgtcgtctgtctgcacgggtttaccggcagcaaacaatcatggacttttcttgatgagatactgtctgattcccgcttgatcaaaattgattgtttagggcatggggaaaccgatgccccgctgaatgggaaaagatacagcacaagccggcaagtttctgaccttgccgagatttttgatcaattaaaacttcacaaagtgaaattgattgggtattctatgggaggaaggcttgcttactcttttgcgatgacatatcccgagcgggtatcggcacttgtgcttgaaagcacgacgccggggctcaaaacacttggggaacggcgggaacgaatcatgcgggaccggaagcttgctgattttattttacgagacgggctcagagcgtttgttgcgtattgggagaatatccctttgttttcatctcagcagaggctggctgaagatattcggcacaggatacgatcgggccgtctgcggaacaataagattgggcttgcgaacagtttaaccggcatgggcaccggttcacagccttccttgtggagccgtgtagaggaaatagatgttcctgtgcttctgatctgcggagagtgggacgaaaaattttgcgccatcaatcaagaggtgcataagatgcttccttctagtagaatagagattgttccaaaagcaggacatacggtccatgtggaacagccgcgattgtttggtaaaatagtgagtgagtttttgacaagcatctgactcattcacatagagaataaaaggaggtcatcatatggctgaatggaaaacaaaacggacatacgatgagatattgtatgaaacgtataatggcattgcaaaaataacaatcaaccgacctgaggtacataatgcgtttacccctaaaacggttgctgaaatgattgatgcgtttgctgacgcaagagacgaccaaaacgttggggttatcgtgcttgccggtgcaggggacaaggcattttgttctggcggagaccaaaaagtgcgcggccacggtggatatgtaggagacgaccagatcccgcgtcttaacgtattggatcttcagcgtttaatccgcgtcatcccgaaaccggttgttgcgatggtgtccggatatgcgatcggcggaggccatgtgcttcacatcgtatgtgacttgacaattgctgcggacaacgcaattttcggacaaacaggccctaaagtgggaagcttcgatgcaggttacggttctggctatctggctcgaattgtaggacataaaaaagcacgtgaaatctggtacctatgccgtcagtacaacgcacaggaagcactggacatgggtcttgtcaacacagtcgttcctttggaacagcttgaagaagaaacgattaaatggtgtgaagaaatgcttgaaaaaagcccgaccgcactgcgctttcttaaagctgcgtttaacgcggacacagacggacttgctggaattcagcagtttgcaggggatgctacccttctttactacacaacagatgaagcaaaagaaggccgtgattcctttaaggaaaaacgcaaacctgatttcggacagttccctcgtttcccgtgatcagcaatacttagtaaaccaacagcttgagactttgcggtccaagctgttttcttttcaatacagacattttacctcggagatgatgacatgctgacagaacagcctaactggctcatgcagcgggcacagctgacacctgagagaatcgctctcatctatagagaccaaacagtgacatttgcagaattatttgccgcgtctaagcgaatggcggcacagcttgccgctcattcggttcggaaaggggatactgcggctattttgctccaaaaccgtgcagaaatggtatacgccgttcacgcttgttttttgcttggtgttaaggcggtgcttttgaatacgaagctgtcaacacatgaaagggtgtttcagctggaggattcgggatccggctttttattgacagattcaagctttgagaagaaagaatatgaacacatcgttcaaacgattgatgtggatgaactgatgaaagaagcagcagaggaaattgagatcgaggcttatatgcaaatagatgcaacggcaacgctgatgtatacgtcgggtacgacaggaaagcccaagggagttcagcaaacgttcggaaaccactatttcagtgcggtgtcgtccgcgcttaatttgggtataacagaacaagaccgctggcttatcgcattgccgctctttcatatcagcggcttgtccgcattattcaaatctgtgatctatggaatgactgtcgtgcttcaccagcgtttttccgtaagtgatgtgctggattctatcaataggcatgaagtgacaatgatatctgcggtgcagactatgctggccagtcttttggaagaaacaagccgctgccctgaatccatcagatgcattcttctcggcggcggccctgcacctctgccattgcttgaggaatgccgtgagaaaggattccctgtctttcagtcatatggaatgacagaaacatgctcacaaattgttaccctgtcgccggaattcagtatggaaaagctcggatctgcggggaaaccgctgttttcatgtgaaatcaaaatagagcgggacggacaggcatgtgaaccgtttgtacacggtgaaatcatggtcaaaggcccgaatgttatgaaaagctattttaaccgagagagcgcaaatgaagcctcctttcaaaatggctggctgaaaacaggtgatcttggttatttggacagcgaaggctttttatatgtattagacagacgttcagatctgatcatatccggcggagaaaacatttatccggccgaagtggagtcagtgctgctttcacaccccgctgtggccgaagccggggtttcaggggctgaggacaaaaaatgggggaaagtgcctcacgcctatcttgtccttcacaagcctgtgagcgcaggagaattgactgactactgcaaagaacgcttggcgaagtataaaattccggcaaaattctttgtgcttgaccgcctgccgcgcaatgcgtctaataagctcttgcgaaatcagctgaaggatgcgcgtaaaggagaactgctatgatcgaaatagaaaaaatcacgctttaccatttgagcatgaacttaaagaaaccgtttaaaaacagtatcgaaacgcttcaagagcgtaaatttctgatcgtggaagccattgatacatcaggtgtctcaggctggggagaagtttccgctttctcttcgccttggtacaccgaggaaaccattggaacatgtttgcatatgctaaaagatttttttatcccaaatgtcgtcggccgtgaattcaatcacccttcagaagtgccggacagcctggcgcgttataaaggaaatcggatggcaaaagcgggacttgaatcggctgtatgggacatctatgccaaaaagaagggcgtatcccttgctgaggcattgggcggaacaagagataaagtccctgccggcgtggtagtcggactggcgcctcttgacgatatgctgaaggaaattgagagctatcaaaaagaaggttatcaaagaataaaaattaaaattcagcctgggcaggatgtggaattggtcaaggccatccgcagccgattcccaaacatcccgcttatggccgatgccaattcctcttacgaactgaaggatatcagccgtttaaaggagcttgatgactatcatttaatgatgattgagcagccgctccaagctgacgatatcgttgaccaccgccacttgcagaaacatttgaaaacggccatttgccttgatgagagcatttgttcagttgatgatgcgagacgggcgattgagctaggaagctgcaaaattattaatataaaaccttctcgtgtcggcggcttaacagaagccttaaaaattcatgatttatgcaaagagcatcatatgcaggtttggtgcggaggaatgctggaaacaggcatatcaagagcgcagaacgtggcgcttgcttcactgcctcaattcacaatacctggcgatatatcttcatcctcacgctattgggatgaagatattgtaacccctgatattcgtattgataatggatttatttctgtgtcaaaacagcctggtttaggggttgaggtaaaccaagatattatgcgaaaatatgtgaccaaaatggatgttttcacacagcatggttaagaaaaaagcattttgctattttgaataaatgacactgtgctgttacagtaaaagtgttcgttgaatacatcccttctcgtttggaccggctgctgacccagccggtttttttatgtaaatcaacttgacaaaaatggccaaacgcgataattttgcacaaaggaaactttttgtcctgtgtaaataaaacatgcttttggctaatttaatgtcacatgtctaagaactgacaacataagataaaacaatcggacattgatggcaaagaggaggagaaatatgagacgagggctgatggcagcagtactttttgcgacctttgctttaacgggatgcggaacggattcagccggaaaaagcgctgatcagcaattacaagtgacagcgacaacatctcaaattgccgatgcagcagaaaacatcggaggtaagcatgtaaaagtcacctctttaatgggaccggggggtgatccgcacctttacaaagcttcccaaggtgacacgaaaaaattaatgtctgccgatgttgttctgtacagcgggttgcatttggaagggaaaatggaggatgtcctccaaaaaatcggcgaacaaaaacaatcggcggcagtagctgaggccattccgaaaaataagcttattcccgcgggggaaggcaagacgtttgatccccacgtctggttcagcattccgttatggatctatgcggtggatgaaattgaagcgcaattcagcaaagcaatgcctcagcacgcagatgcctttcggaaaaatgccaaagagtacaaagaagatttgcaatatttagataagtggtcgcgtaaggagatcgcacatattccggagaaaagccgtgtgcttgtgactgctcatgatgcgtttgcgtactttgggaatgagtatggatttaaggtaaaaggcctgcagggactcagcacagattcggactatggattaagggatgttcaggagctgattgatcttctgacagaaaaacaaataaaagctgtgttcgtagaaagcagtgtatctgaaaaatcaatcaatgcagtggtggaaggcgctaaagaaaaaggccatacagtcacaatcggcggtcagctttattcggatgccatgggtgaaaagggcacaaaagaaggcacatacgaaggaatgttccgccacaatatcaacacgattactaaagcgcttaaataaagaaaagaggtggaggatatgttccctgttgagcttgataatgtgacggttgcttatcataaaaagcctgtactgcaggacatttcgctgcaggtgcctgaaggaaaacttattggcattatcggcccaaacggcgcgggaaaatcaaccttgatcaaaacgattctcggtcttgtgcccagagcttccggagacatctctatttacggcaaagactataaggatcagcggaccagaatcggatatgttccgcagcgcggctcggttgactgggatttccccacaagcccgctcgatgtcgtcctaatgggaagatacgggagaatcggtttattaaagaggccaaagaaagcggatgtggagatggcgaaggccgcattaacaaaagtcgggatgcatgattatgcgaagaggcaaatcagccagctgtcaggcggacagcagcagcgggtgtttcttgcccgggcactctgccagaacgctgacatttattttatggatgaaccgtttgcaggtgttgatgcagcgacggagcgcgcgattatgacgctgttggcagagctcaaagaaaaaggaaaaaccgtgcttgtcgtccatcatgatctgcagaccgccgaggattatttcgattggatcttactgcttcatttaaggaaaattgctttcggaccggcggaaaacgtttttacgatcgaaaacctgcaaaaaacatatggaggaaggcttacgtttttaaaagataaagtgctggcagaaggacataaggagtgagcgcaatgtttgaaagtttgtggctgcagcttcagcatccgaatacacagtgggtgctggccggtacgcttttgctcgggacggcaagcggtgttttgggcagctttgtgctgctgagaaagcaaagtttaatcggcgatgcgatggcccattcagctctgccgggagtgtgtctcgcttttctgttcaccgggcaaaaatcactgcctttctttttgctgggggcagcgctcgccggactgctcggaacgttttgtattcagctgattcctcggctttcaaaaacaaaggaggactcggcgatcgggattgttctttctgtgttttttggcgtcgggatcattctgctgacatatattcagcaacagggggcgggaagccaaagcgggcttgattcttttttattcggccaggctgcttcattggtcaggcaggatatcatccttattgcagggatatccgctgctctgctgctcctatgtattgttttctttaaggaatttacattgattacttttgatctcgcgtttgcaaagggattaggaatcccggtgcgttttttaaacgggcttttggcttgtctgattgtctgtgctgtcgtcattgggcttcagactgttggtgtgatattaatggcggctatgctgattacacctgccataaccgcgagatattggaccgaacgattaaccgggatgatcatcattgccgggattacaggcggggtcagcggagtggccggaaccctgcttagcaccacgatgaagggaatggcgacagggccattaatgatcttatctgcaacgctgctctttcttttttcaatgatttgcgcgcctaagcggggattggctgctaaagccataaggctgatgaggctgcggcgcagaacaagcagggagcaagtgcttttggcgatttatgaacagtatgaaaagaaaaatctttgtgtaactgttgaaagtgtaagaaagaaaagacgcctatccccttcattatgccttaaggcattaaatgacttggaacaagagaggtgcattgagcgtatcgaaaatgggatttggcaaatcacaagcaaagggattgaaaaaggctatcacacagctttgaagcagcggatgtatgaagtgtatctcatgcatgaaatggaacttgccaatatagaatccgatcaggactactttgacccggaccgtttaccgagagaaacgagagagcggctttattcactcttaaagctgtatggacggatgcctgagcttcgaaaagtgtctcatgatgccgagaagggacagatcgcgaatgagttttgaagcatggattatagctaccggtgtattagtcggtgtaagctgcggattgatcggcacatttcttgtactgagaagcatggcgatgctggccgacgcaatcagtcatacagtgttgcttggcattgtcggcgcttttctagtgacgggaagtctcgatgggatttatatgtttattggcgcagccgcaaccggtctgttaacggctttcttggttcagcttcttcatagcaagggggttcaatcagatgctgccataggagttgtgtttacatccttatttgcaatcggggttattttgctttctgtgtatggagcgaatgtccatctcgatattgagcactcgttaatgggagaaatcgcttttgtgccgtggaatacggtgacggtattcggggttgatattgggccgaaagcgttttggatgctggcatctgttctggttttaaacgtagtgttgatcagtgtgtgctataaggagtttaaaatcgcttcgtttgatcctcaaatggctttagccttgggaataccggttttgctcattcattacgtgcaaatgggcatgctgtccttgacgactgttgcttcctttgattcggtgggtgccgtattggttgtggccatgctgattgttccgccggctgcggcacatttgctgacagaccggcttctttatatgctgattctcagcgcgttgattggcgggctgtcggcggtcatgggctatttcttcgcaacgtggcttaatgtttcgatttcaggagcgatggcggccatgacaggtgtatgttatgcaagcgcctttttgttttcacctgcaaacggggtcataactaaaaagctgagaacactcaacatgcaaaaagaaagagctggctgatgcagctctttcttttaattacaaatcatgcggcttaaacgttttgcagtctgtttcccggctgttttcagccgtttcaccagtatggctgacaacataaatggcatcagcggtgcatttgttacctttgccccaataagaacagttgttgacctcacatagaattttctgctccatgccatcccctccttataaaggttctggattagtatagccggctggcttgccctctattcctcctggcggatatagcgtttatctcgcataaacattttccagaagaaataaaagcccggaaatagaatgataaatgcaacgatatacgttgcaaacagcgctctgaacgttgctggctctgtgaagcctgacatgactgtcacatcgggataaatcatatacggaagatgcgcccgcccgtacgcgtagcttgcgagaaaatactgtatcccaatcgcgacaagtgcaagccgcggttttccgatgttttgcccaaagctcttattaggcagaaaaagggcgattccagcaatgacaaatgtaatgaacgatgcaataatccaagtaaaatcattcatcattccgctgtacagccagtttgcttcattccgcattgtcaccataatgcatactgcaaacaacagtgaaatcgggccggtaatcagggcgctttttctgtaggctcggtacgcatcctgttcctctgccacatttgaaacatctgcaagcagcagcgaggacaaaaataaggtgcttaaaatcgcaaacccgataaatgaataggcgttggggcttgaaaagattttagacatatttaagttatagattctatccgttttttctataaaccctccgtgtgtcacaggaagcaccaaaattaaaatagcaggaatgataaagccggagatgccggaaatatatcttagcgttttccgctcctttgctgtatttgaaaacacgagaaatccgcttcgaatcgctaaaagcagtaaaatcatgcttccgggaattaataaaacggtgccgagcacaaatgtcgcgccggggaaaaaactgaaaagcgccacgacgatggccacaataaagacatttgtgacctcccaagtcggggacaaaaagcgattcgcaatatcggtggccttcatatgctccttgtttaaatagatcatagaccaaaatcccgctccaaaatccattgtcgccatgacggcgtaaataaacacaaagccccagataattgagatggcgatcagagcgtcagttgaaatctccatttgtcgatcttccttccatttggtttcctgtttgcggagccattacgactccgctgtatttaaatcttcgtcaaccgggtgcttgcggaaatagtacagcagcacgtagacgacagctgcgcctaacacggcataaacaaatgtgaaaaataagaacagcaccccgatcgagccagtcgttgttacgacatctgacgttttcagcagatgatagatgacccaaggctgcctccccgtacatgcgaaaatccagccgaattcaatgccgatgagactaaaagggcctgctgtcatgaaaatgatcaaaagccacgttgggaaacggtctttcttgagcacctttctccagaccacaccgatgatggaataaagaattagcagcatgcctacacccaccatcgcattaaacagcgtgtgaatgaaaagcggcggccattcatctctcggaaatgcatttaatccttttacaacagtgtcaaaacggttcgctgccaaaaagcttaaagcccatggaatctcgattgcccattttactttttcttcattcgggtcggtaaaaccgccgatagcgagcggggcgtgggatcttgtttcaaacaggccttccgcaccggctaatttttcgggctggtattcgtacagcatctgtgcagattcgtgtccgttcaaagcggtcagcaatgaaaaaataccgccgatcgtcagtgcgagcaaaagggctttccggtgaaagcgatagaccttttcctttttcctcgtccggatcattttatacgccgcaacagaagccacgataaacgcacctgtcataaacgcggacagcacgacatggccggcagtgataaaaaagctaggattaaaaaacgcagcccacgggtcaacatctgtaatttttccgtttaaaattttaaaaccggcgggcgtaccttcaaaagcgtgaacattcgtgatcagaacagcggatgctgctgccccgactaacacaaagaaaacagcaacaatcctcattgcaggtgacaaacggtctgcagcgtatacataaatcgacatgaatagggcttcaacaaaaaaagcatagatttcaatttgaaatggcagggacatcacccggccgatgacttccataaatcccggccataaaagcgcgagctgagtgcccgcgatcgttccggtcggtatggcgacccccagcaaaacggcttgtgctttcgtccatcttttcgccatgatcgcataatggtcatctttcgttttttgatagatcaattccgccactaaaatcatgagcggcagaccgactccgagtgttgcgaaaataatatgaaagcccattgtcgtgccaaagaggcttctggccaaaactaaatcatccacaatcgtaaaccacctttccaaaaagacgttctgtatgtattttgggtttattatttgcttcctcggttagattattcttcctattcttaaatgccatgaggtttacgatgtgaaaacagagggaaggatataagaagattgacaaaacgtttgtaaggttataaaataaaacgtaattattacgatttattgaaaggagattcacatgaaagaaggaattcatccgaagaaccacaaagtgatatttcaggatgtcaacagcggctaccgttttctcagcacctctacgaaaacatctaatgaaacagcagagtgggaagacggaaacacatatcctgtcattaaagtagaggtaagttctgacacgcatccgttttatacaggccgccagaaattcaatgaaaaaggcggacgagttgagcagttcaaaaaacgctataacatggggaaataaggcaggcctgagggtttgtctttttttattatgacgaataaacaagggttgtgatatattgaagagtaaaaagaatagaaagggacaacgaacatgagtcttctaaatgatattctcgaatttaacaagacatttactgaacaaagagagtatgaaaagtatcaaacatcaaaatttccagataaaaaaatggcgattctttcttgcatggatactcgtctggttgaactgctgccgcatgcgatgaatttgcgaaacggtgatgtgaaaatcattaaaagtgccggtgcgcttgtgacacacccattcggaagcatcatgagaagtatactcgtcgcagtgtacgagctgaatgcagatgaggtgtgtgtgatcgggcatcacgattgcggcatgagcaaaatcagcagcaaaagcatgcttgaaaaaatcaaagcaagagggattccggaagaacgcatcgaaacaataaagtactccggtgtagactttgatcaatggtttaaaagctttgattcagtggaagcgagtgtgaaagacagcgtagatgttattaaacatcacccgctgttccctgaaaacgttccggtccatggcttagtcattgatcctaaaaccggaaaactggatcttatcgtaaacggttataacaattaatgtttttgtttcttttcaggaacgggatcgactcctcccggatggaacgggtggcatttcaaaatccgtttgattgtcagccatccgccttttaaagcgccatgtgttttaatcgcttcgattccatattgggaacaggtcggataaaagcggcacgttggcggtgtcaggggcgagatgaatttttgatatcctctgatcagagcgatgaatagggttttcatgtttcttcagcaacctttctgatgcaagtataagaaaaaaaacacagattgaaaagttaatcaataattcttatcggaaaagtatgttataatgaaattacatttttaaaaaaggggagagtgccattatgccttcagtagaaagttttgagcttgatcataatgcggttgttgctccatatgtaagacattgcggcgtgcataaagtgggaacagacggcgttgtaaataaatttgacattcgttttagccagccaaataaacaggcgatgaagcctgacaccattcacacactcgagcatttgctcgcgtttacgattcgttctcacgctgagaaatacgatcattttgatatcattgatatttctccaatgggctgccagacaggctattatctagttgtgagcggagagccgacatcagcggaaatcgttgatctgcttgaagacacaatgaaggaagcggtagagattacagaaataccagctgcgaatgaaaagcagtgcggccaagcgaagcttcatgatctggaaggcgctaaacgtttaatgcgtttctggctttcacaggataaagaagaattgctaaaagtatttggctaaaatagaaaggacctttttgcgcataagcaaaaaggtcttttttgtgacgtctcatattttgtgtaccatttgctgtaagcgtttgctactatttaggtaaacgatgaaagggtgatggcatgaaaaagatgttggttgttctgcttttttctgcttttttgcttaacgggtgcggatctggtgaaagcaaagcaaatacagctgagacgcccgaggttttggatgtcaagctgaccgggcctgaaaaagtaaatcccggagaaagcgctgcttatgaagcagccgtatcatatggtgatgaagctgtgacggatgccgatgaagtagagtttgaagtatggaaagaaggggaaaaagacgcaagccaaatgtttaaggcgaaacaagaaaaaggcgtataccgattggaaacgacgtttaaggaagatggtgtatacactgtccaatcccatgtcacagcaaaaaaacagcatagcatgccgaccttaaaagtccaagtcggagacgccgatgctgccagcaatcagtcagaagaggagcattcacatcatcattgattgtgtgaatcagagtgattttcttgtggtggatcaatggtatgctttacattataggcttttacagtcgtccaaatggttacaagcaaaacagccagcacaatcaaaatacttatcgtaatgagaagcgtcatgacattccacctcccgttttttaacaattgtagcataatagaagaaatcgtgacagataagggtaaaaaagaggttttagcgtacgatattaagggtatacatagtcatataacaaggaggagataccatgtcagaacaattgattcaagcagtgaacaaacaagtagccaactggacggtcatgtatgtgaaactacataattatcactggtatgtgaaaggaaaagatttcttcactcttcatgaaaagtttgaggagctgtacaacgaaacagcaacttatattgatgacttagcagaacgtcttttggcgctgaacggaaaaccgattgcaacaatgaaggaatccttagaaacggcttctgtcaaagaagcggctggaaatgaaacagctgaacaaatggttcaaagcgtatatgatgatttcacagtcatcgcggaagagctgaaaaacggcatggatttagctgatgaagtcggtgacgaaacaacaggggacatgcttcttgcgatccatcaaaatattgaaaaacataactggatgctaaaagcttacctaggttaagttcaaaaatagaacggtcggatgtcttaaaaaagacgtccggcttttctttttgtatcttaaaaataggcgacaaccagtccatttttctgaaaaatccaatccgttcggcttgttttccatagaatatcgtaaggccgtttctgtgaaaggatgttgggataaatggatagagactttggcatcttttcgttaatagcagtcagcgtttcagcagcgggttttttctttggaggttttcagtattcatttctgattttgctctctcttatggcaattgaatttatcagtacgactttgaaggaaaccattattcacaaactgtcatttaaaaaggtatttgcccggcttgtcaaaaaattagtcacgctggctctgatctctgtatgccacttttttgatcagctgctgaatacacagggatcaattcgtgacttggctattatgttttatattctttatgaatctgtgcaaattgttgtgacagccagctctcttggcataccggttcctcagatgcttgtcgatcttttagaaacgttaaaaaataaatttaagcgcaaaccgtaacttttccctgttcgcgggtcataataaagcccagagcgtcggtcgcactttccggcaaaagtatcgcaaaaaaactgtacgagctagtctgcatgcagaacctgacggcgtgctgggtcccttattttttgataaaaggcttccgaagaaacgtaactgtggtatgatgtatggaagatagctaggaacggatttgagggataaacatgtacgagtttaaagattattatcagaatactgttcagctttcctttgacgatcagcctttctcggacagcccgaagcatgtctgggtgatttgccgttttggcggtaaatggcttttaacagaacatgaggacagaggctatgagtttccaggcgggaaagtagagccgatggagtgcgcagaagaggctgcgctccgggaagtaaaggaagagacgggcgcgagagtcaaaagcctcaagtatctcggacagtataaagttctcggaaaagaaaaagtgattgtgaaaaatatatattttgcagatatagaaaagcttgaaaagcaagctgattactttgaaacgaaaggcccggttttgtttcacgagcttccggagaacctttcccgcaataaaaaattcagctttattatgaaggattccgtacttccgatcagtttgaaaaaactgaaagaatctggatggattgaataaaaaacccggcatatatgccgggttttttatgtcctccccttcgtccatttcttttccagcagctcgacgccctgatacatcagagtggcgaagatggcgatgatcagcaggcttaagaagacgagtgtaaaattgaagacttggaatccgtaaataatcatatatcctaatccgaccttcgaaacgaggaattctcctacaatgacgccaacccatgataaaccgacgttcacttttagtgttgaaataatcgcgggggaggatgcaggcagtatgacttctttaaaaataacccacttttttgcgccgaatgttttcatgactttcgtatagttttcgtcgacctcttggaaggcggtgtagacaacgatggttgtgataatgacgctgatgatggctcccatcgcaatgatgctgataaaactgggaccgagcgcgacaatcaggatcgggcctagggccactttcggcattgcattcaaaatcacaagatacggatctaaaattctggcaagtcggttagaccaccataacaaagcggcgagacacgtgcccataaacgtcccaagcaaaaagccaagcaccgtttcaaataaagtgacgccgatgtgtgacagtaaagaaccgtcaccaagtttctccagcaataatcgccacacagctgagggagagctgaagatcagcggatcgatccagccctgcctgctggaggtttcccagcccgagaaaaagagaataaatatggcaagctgaaaggaatggaccttccacttttcctttttctgtttgaattgatactgctcgtgaagcagatcaatggtttctttgctgtttctcaagagaattcagctccttccatatcgtttgaaacagtgtctggaaggaaggttcctgacgggcgtcaaaaggcaacattgcggccaattccttaggaatggtaaaaatctgatggatggtacccggctgatttgaaaataaaaagatcgtatcgctcatcgctatcgcttcccctatatcatgagtgacaagcactgctgttttttgatattcctttaatgtgcggaataccaggttttctaaagacagctttgtctgaaaatcaagcgcggaaaatggctcatccagcaaaagcagactagggttaggcgcaagtgttcttgcaagcgcagcccgctggcgcatcccgcctgacagctctttcggatattttttctccacatctatgaggccgaactccggcaatagaccgagtgcagcggctttgctttcttctgtcagcgtgtcggcgatttttaaaccgagaagcacattttcctcgatagatttccagggaaataagtaatcctgctgaagcatatagccaatattatgttctttttgattcggctcacggccttcaatcagaactctgccttctgatggctcaatcaaaccggcaataatggaaagcagtgttgtttttccgcagccgcttgggccgagaaatgagatgaaatcgcctttttcggcatcgaaatgaatatcccgcacagccgttgttttttctttaatagaaaaataagtatgggttacatggtcgacatgtaagaaagacatagatggcgcctcctatttctccgaggtgactttttcagcaatatgtttatttacaagctgattgtatggaatgtgcttcggcagttctcccgattgatccataatggtttggagaagctcccattctttttcgttaagcagagggtctggcgaatatgaatgctgttttttatagcgttcaatggatgtttcgatgacgtctgggtcggtatcatcaaattcatctttaatggcatctgtgatgtccttcgcagaatggttttcaacccactgctgcgccttataaatggcctttgtaaacttgacggctgtgtcttcatttttcttcaaatagctttttttcgccataaaagtcgtataaggaacctctcctgattcttctccgaatgaagccacgatatggccgatgccttttttctcaaagagagaagcctgcggttcaaagagctgtacatactcaccggttccagaagcaaacgcattggcaatattggcgaagtctatgttctggataaggtctatatccttatgcgggtcaatcttatgtttgttcagcacatactcgccgaccatttgcggcatgccgccttttcgctggccgagaaacgtttttcctttcagctgatcccagtcgaagtgttcaacattttctctcgcgacaagaaacgttccgtctgtctgagtcagctgggcgaaattaatgacgggatctttagccccttgcgcttcgacataaatagatgtttctgacccgacaagcgcgatgtcggagccgttggaaagaagcgatgtcatcgttttgtctccgccccaggtcgtattcacatcgacatcaagcccttcttccttaaaaaaacctttagactcagcaacatataaaggtgcgtaaaaaattgaatgggtcacttcagctactttgactttggtgagcgtttcttcctgcttgcaagccgccagggcgatcatcagaaagatactgccgacacaggcgaagcccagccttaaccatctgttcacatagacaacctccttatttcgcatcaagttaatatccttttttgctttacatatcgtatgatgggtataaaaatgtgtgaatgcctaaccaggttctccggatgtaattttggagtaaggaaagcatatagaaaaaaaggaggcggctgttttgattgtagagaaaagaagatttccgtcgccaagccagcatgtgcgtttgtatacgatctgctatctgtcaaatggattacgggttaaggggcttctggctgagccggcggaaccgggacaatatgacggatttttatatttgcgcggcgggattaaaagcgtgggcatggttcggccgggccggattatccagtttgcatcccaagggtttgtggtgtttgctcctttttacagaggaaatcaaggaggagaaggcaatgaggattttgcaggagaagacagggaggatgcattttctgcttttcgcctgcttcagcagcacccaaatgtcaagaaggatagaatccacatcttcggtttttcccgcggcggaattatgggaatgctcactgcgatcgaaatgggcgggcaggcagcttcatttgtttcctggggaggcgtcagtgatatgattcttacatacgaggagcggcaggatttgcggcgaatgatgaaaagagtcatcggcggaacaccgaaaaaggtgcctgaggaatatcaatggaggacaccgtttgaccaagtaaacaaaattcaggctcccgtgctgttaatccatggagaaaaagaccaaaatgtttcaattcagcattcctatttatttgaagagaagctaaaacaactgcataagccggtggagacgtggtactacagtacattcacacattatttcccgccaaaagaaaaccggcgtatcgtgcggcagctcacacaatggatgaaaaaccgctgacagtgaaatatgttatgataaagaaaaaagagaacgaaaggggatttcactttgggaatgcctgttgaatttaatacactgattgtgacaaaaggaaaagaagttcgcatagatgaaaatatattcacgttagagaaggacggataccgagtatatccgatggagattccaatggatgtacgcaaaacaaagtttggcgaaaagtcaggcacagctgaagtgcagaagcttcaatgggaagaaggccggaccatcattacatacaagctgacttctttgcattccgtcaattaaaacaagccaagagcataattgctcttggcttttgttttttatacgagagggccgcctgcctgggcgatggcatcggtatgtgcgaactttttaaagttctctttgaattcatttgcaaggtagactgctttttctttgtattcttccttgttggtccacgtgttttcaggctgaaggatatgatcaggaacgccaggaacatgggccggaatgtgcaggccgaaaatatcgtcagttatcatttcagcatcctctaatttgccttcaatcgctgctttgaccattgctctagtgtaagaaagcttcattcgttcgcctgtgccgtagccgcccccggtccatccggtattgactaagaaaacgtctgcgccgtgttcatcgatctttttgccgagcatttcagcatagacgtgagcaggaagcggcaggaacggtgagccgaagcatgtagaaaacgtcgtttcaggagacgtgacaccacgttcggttccggcaagcttactcgtgtaaccgctcaagaaatggtacatcgcctgctccttcgtcagtttgctgatcggcggcaggactccgaaggcatcagccgtcaaaaatacaattgctgacggatggccggccatgcttggagtcacgatgttgtcaatcatatgaatcgggtaagctgcccgcgtgttttcagtatagaaggaatcatcataattggcttcgcgtgtatcttcatccacaacgacattttcgagaacagacccgaagcggatcgcgttaaagatttgcggctccttttcctcgcttaaatgaatgcacttagcgtagcacccgccttcaatattaaagacgcctgtatcagaccagccatgttcatcgtcaccgatcagcttgcggtcagcatctgccgacagggtggtcttgcctgttcctgacagtccgaagaaaagggcgacatcgcctttttcaccgacattggcggagcagtgcatagataaaatatctctttcaggcagcaggaaattcataatggagaaaatggactttttcatttcaccggcatactcagttccgccgattaaaattgtccgcttttcgaaagagacaataataaacgtttcggaatgagtgccgtctgtttttggatccgctttgaagtgcggagcagaaagaatggtgaacggctgctcaactgttttcttatcatttccttccggacggataaacagctgccgcgcaaataaattgtgccatgcgaactcatttacgacagtgatcggcagcctgtatttctcgtctgctccggcaaatccttcgaaaacaaacagttcatctcgctcctttaaatagctgacaactttcgtgtacagccgctcaaacgcttcttctgaaatcggctgattcaccgggccccaatcgatcttatttttcgtgctttcttcctccacgatgaatttatctttaggtgagcgtcctgtgtaagcgcctgttgtcgcgcgaacagcacctgtggatgttaaaatgccttcgtttcgggagaggactttttctgttagctgtgctgctgataaattatgacgcacatttggacatgttaataaggcttgtaaatcagcggtcaaatcaactgagttcatatgaaaccttcctttatcgttttttgtgttttgctaattgtgaattagtataacatatattttcaaatagtctatactatttattgttttttgtgtgtgcatttccattgttttccctcaatataggtgcctatttcttctgaatcatattgacattgcaaacccttttacgataagatatttcattgagcggatactcttatcccgagctggcggagggacaggccctatgaagcccagcaaccggtttctctgttatttattatgttcaactgagtgagacaaccaaggtgctaacctgttgcaaggttgtatgattccttgagcgataagagtgaaaggcacaaagaccaaaccctttcctcgatggaaaaggtttttttatttcataaatatgccaattaacattctctaatataactgtacattgtataagagggagcgagttccgtatcatatatacaaggtctttcgggaggccttgtgcaggaggaagcaaatcatgagtaaaaatcgtcgtttatttacatcagaatctgttacggaggggcatccggataaaatctgtgaccagatttctgacagcattttagatgaaattttaaagaaagaccctaacgcgcgtgttgcttgtgaaacatctgtgacaacaggtttggttcttgtaagcggagagatcacaacttctacgtatgttgacattccgaaaacggttcgccaaaccattaaagaaatcggatacacacgtgcaaaatacggatttgatgcggaaacttgtgcggttttaacatcaattgatgagcagtctgctgatatcgcgatgggcgtagaccaagcgcttgaagcccgtgaaggcacaatgagcgacgaagaaattgaagcgattggtgcgggtgaccaaggattaatgttcggttatgcgtgcaacgaaacgaaagagcttatgcctcttccaatttcacttgcccataaattagcccgccgcctaagtgaagtccgtaaagaagatattcttccgtaccttcgccctgacggcaaaacacaggtaacggttgagtacgatgaaaataacaaaccagtccgcattgacgcgattgttatttcaactcagcatcatcctgaaattacacttgagcaaattcagcgcaacattaaagaacatgtaatcaatccggttgttcctgaagagctgattgatgaagaaacaaaatatttcatcaaccctacaggacgtttcgtaatcggaggccctcaaggggatgcgggacttacaggacgcaaaatcatcgttgatacgtacggcggctatgcacgccacggcggaggcgcgttctcaggtaaggacgcgacgaaggtagaccgttctgcagcttatgcggcaagatacgttgcgaaaaacatcgttgcggctgagcttgctgattcttgcgaagtacagcttgcttacgcgatcggtgttgcacagcctgtgtcaatctcaatcaacacattcggttcaggaaaagcttctgaggaaaaactgattgaagttgttcgcaataactttgatttacgacctgccggcattatcaaaatgcttgatttgcgccgtccgatctacaaacaaactgctgcgtacggccactttggacgtcacgatgttgaccttccttgggagcgtacagacaaagcggagcagctgcgtaaagaagcgttaggagaataattttatagccgcttactggttaagcggctttcccttttttatcgttgtattcatgtttatttttttacataactgtgaaaccaaatattattcacagcgtctataaataggggttcaatgatgacaattttaattatggaggcaatactatgtgtggatttgtcggggtttttaacaagcatccgttagctcaaaccgctgatcaagaagaactaatcaaacaaatgaaccaaatgatcgttcaccgcggtcctgacagtgatggatatttccatgatgagcacgtcggcttcggattcagacggctcagcattattgatgtagaaaatggcggacagcctttatcatatgaagatgaaacatattggattatctttaacggagaaatctataactatatcgaactgagagaagaacttgaagcaaaggggtacacattcaacacggattcggacacagaggttcttcttgcgacttaccgtcactataaagaagaagcggcgtccaaactgcgcggtatgtttgcctttctgatttggaataaaaacgatcatgtgctttatggggcaagagatccattcggcattaaaccgttgtactacacaacgatcaatgatcaggtttattttgcctcagagagaaaaagtttaatggttgctcagaatgatattgaaatagataaagaggcattgcagcagtacatgtctttccaatttgttcctgaaccaagcacgcttgatgcccatgtgaaaaaagtagagccgggttcacagttcacaatccgcccggacggcgatatcacattcaaaacgtatttcaaagcgaacttcaagccggttcagactgaagaagacaagcttgtgaaagaagtccgagacgcgatctatgactctgtaaacgttcatatgagaagtgatgttcctgtcggttcgttcctgtctggcgggattgattcttcctttattgtgtctgttgcgaaggaatttcatccaagcttaaaaacattctctgtcggctttgaacagcagggcttcagtgaggttgatgtagcgaaagaaacggcagcggcgctgggcattgaaaatatcagcaaagtcatttcgcctgaggaatacatgaatgagcttccgaagatcgtatggcattttgatgacccgcttgctgatccggcagcgattccgttgtactttgttgcaaaagaagcgaaaaaacatgtaacggttgctttatcaggtgaaggagcggatgagctcttcggcggatataacatttaccgtgaaccgctttcgcttaaaccgtttgaacggattccgtccggcttgaaaaagatgcttctgcacgttgctgccgttatgcctgaaggtatgagagggaagagcctgcttgagcgcggctgcactccgcttcaggatcgttatatcggtaacgcgaaaatctttgaagagtctgtcaaaaagcagctgttgaagcattataatccgaacctttcatatcgcgatgtgacgaagacttactttacagaaagcagctcgtacagcgatatcaacaaaatgcagtatgtcgatatccacacttggatgcgcggcgacattttgttaaaggcggataaaatgacgatggcgaattctttggaactgcgtgtgccgttcttggataaagtcgtattcgacgtcgcttcaaaaattcctgatgagctgaaaacgaagaacggcacgacgaagtatcttcttcgcaaagccgctgaaggaattgtgcctgagcacgtattaaaccgcaaaaagcttggtttccctgtaccgatccgtcattggctgaaaaacgaaatgaacgaatgggtgcggaatattattcaggaaagccaaacggatgcttatatccataaggattatgtccttcagcttcttgaagaccattgtgcggacaaggctgataacagccgtaaaatctggactgtgctaatctttatgatctggcacagcatcaatattgaaaaacggtatatgcctgaagagctgagccatcagcctaaagaagtcatctttgtgtaacagacaacaaggctttcgagtagtcgaaagccttgttgttatccttttatttctccatcatcattgatttacccaatccgtacggaatattcagaaaaatgatataatgatatttttttctaggggagaagaagcatgcaaaaacaaaaacaagagctgcaccgcggactcgaagaaaggcatatttctttaatgtctttaggagctgctataggagtagggttgttcctcggctccgcatcagctattcaattagcagggcctggtattttggtagcgtatgccgcaagcggcctggtcatgttttttattatgagagcgcttggggaaatggccattcaaaaaccggtcgcaggctccttcagcaggtatgcgcgtgactacttgggaccgcttgcaggctatttaacagggtggaactactggtttttatgggttgtcacctgtatggccgaaattactgctgtcggtatctatatggggttctggtttcctgacgtgccaaactggatttgggcattatcggcactggtcattatgacgggtgttaattttctggctgtcaaagcttacggtgagctggaattttggttcgcattgattaaaattgttgcgatcttatccatgattgctgtcggtttattgatgattattgcaggagtcggcaatgggggcattgccaccggaatcagcaatttgtggaacaacggaggatttttccctcatggtttaaaaggggttctattgtctcttcaaatggtcatgttcgcctatttagggattgaaatgatcggggtgacggctggcgaggtgaaaaacccgcaaaaatcgttagccaaagcaattgatacagtattttggcggattttgattttttatgtaggcgctttatttgtcattatgtctatttatccgtggcaggaaattggctctcaaggaagtccatttgttctcacatttcaaaaagtgggcattccatcggccgcaggtatcattaactttgtcgtgttgacagccgcgctgtcttcatgtaacagcggtattttcagcacagggcggatgctgtttaacttggcggaacagaaagaggcgccacaagcatatggtcagctgacgaaaggcggcatcccgggtaaagctgttctggcttcagcgggcgctttattagtcggagtgctgttaaactatgttgtccctgcgaaggtatttacttgggttacaagtattgcgacgttcggagcgatttggacgtgggcaatcattttgctttctcaaatcaaatacaggaaaagtttgaagccggaagaaaagaaacaattaaagtacaaaatgcctttatttccgtttacgtcttatgtgtcattggcatttctagcattcgtcgtcattcttatggcttacagccctgatacaagagtagccgtgattatcgggccgatatggtttctcatcttgctggctgtgtactatggaaaagggtttcacaaaaaaaatgcagcagctgccagcgaacgaaatatcagctgacaaaaagagctcccagtgggctctttttgtgtgtgctcatagaaaatagagaacaggaaagaataggtatgtgtgtttgcagaggctgtttacagttttgtgataagataaaagtcatacgtttagatgccatatgtgaacgttttatggaaaaatcgaaacccgaactgtgatgacgtccgggttaacgatggttattgctttcaaatataatttgaaaaatggtaaagtaagacgaagcaggtcttatgtttgttgaagaaatttataatattggcccttttctacatattctgaccgtattctttgcatatcttttcggtcttcttccgtcaaagggcggatgacttttgcagggcggccaaaggcgagatggccaggcggaatgatttttccgggcgggacaagactgccggcaccaataaaagcgccttcgccaatttcggctccgtctaaaatgattgagcccatgccgattaaggcgttcttgcggataacagcgctatgaagtgtaacctgatggcctatcgtggcgtcatcttcaatgagcagcgtcttgttcgggctttgatggaggcagcttaaatcttggatattgactctgtttccgattctggtcggcgcaacatctccccttatgacaacagaaaaccaaatgctggactgttctccgatcacgacatcaccggtaattgttgcattatcagctataaaggctgttgggtggatatctggcttgtgttccttataagggtagatcataagattcatccttctttctctatttaaatttcgtatgaggtgaagaacatgtggacctggaaagcagacagacctgttgcagtgattgtaatcattcacggggcaagtgaatatcacggacgatataaatggctgattgaaatgtggcggtcttcgggttatcacgttgtcatgggcgatttgcctggacagggaacaacgacaagagcgagagggcatattcgctcgtttcaagaatacattgatgaagtagatgcttggatagataaagcgcgaacttttgatctgccggtttttcttctaggtcacagcatgggcggtctggtcgcgattgaatggattaaacagcaaagaaatcccaagattacgggaattattttatcatcaccgtgtctcggactgcaaattaaagtgaataaagcgcttgatcttgcatcaaaaggcctgaatgtcatcgctccgtcacttaaggttgattcgggattatcaattgatatggcgacgcgcaatgaggacgtcattgaggctgaccaaaatgattcgttatacgtcaggaaagtttctgtcagatggtacagagagcttttaaagacaattgaatcggcaatggtgccgacagaggcatttttgaaagttccgcttcttgtgatgcaagccggtgatgacaagcttgttgacaaaacgatggtcatcaagtggtttaatggtgttgcttctcataataaagcatacagagagtgggaagggctttaccatgagatcttcaatgaacccgagagagaagatgtttttaaagcagcaagagcgtttactgatcaatatatttgaactagtagggggtgcatgtgttgacagtaccggaacatccttttggattgatggcaaaggtatatcgagatatttttccgctcgttcatcaagagctggacatatggaagcaaaaatcagaatcgattcataacagtgaattgaaagcacaggcaaccgcaagtattcgggacaaaacgtttcactgtgaaggcggcggcatactggccttattgtcaggcagccaaaagcagaaatgtgtcgagtttatcatcgcgtatcaaacgattagtgattatttggacaatctgtgtgaccgcagcacctcgctggacccgcaggattttcggatgctccatgcctcaatgcaggacgcactgacagtgggggcggaactgcaaaactattatcaattcagagaagaacaggatgacagcggatatctgcacgaactggtcaaaacgtgccagcgtgtccttggttccattgagcactatgacatgattaaaccttatctgcttgaactgtgcggctattattgcgatttgcaggtgcataagcacgttattgagcatgagcgtgttccgcggcttgaaaagtggtttactcaatatgaatcagagctgcctgagatggaatggtatgaattttcagcctgtgcaggctcaacgttaggcattttctgtctggttgcgtattcgttccagcctgatttcacagaaagcaccgctaaaaaaatccgcgacagttattttccttacatacagggccttcatatcctgcttgattatttgattgatcaagaggaggacttgctggaaggagacttgaatttctgctcatattatcagtctcatgaagagatgatgaatcggcttgaacactttatccataaagccgacgagcatttacaaggcattccgcatgaaaacttccatcgtttaatcaatcgcggcttgcttggtgtttatttgtcagatgataaagtggcaggccaaaaggaaatgggccggctcgcaaagaagctgatcaaagccagcggaaaaacctcccttttcttttatatcaacggcagagcctaccggaaatttcaaaaaatgtcctggatgaaaaactcaaagaaaaaagctcaaatcatttgctgatctgagcttttttttcgatggcgacaataaatggcgggtcattttgctgattgataaacccgtaagttaatacacgggctgattgctggtccaagtcccggcaaaactcgagcacgtcgtttttttcagctttgccttccgggtggccatgatagacgacgagaacaatcagaccttcgtctttcatgatgctgagaagctgttcaattgctttgatcgtagaactgccgtttgtcgtaattgatttgtccccgcccggcaaatagccgaggttaaataccgcggccgccactttgccatgtgtttcaggcgggagggattcagcgattttgtcatggcttttgtgaaataacgttgttcgcgcttgatacatgtcaccaagccgttcctttgtattggccacggctgattcttggatgtcgaatgcgtacacatggccgttttcaccgacaagctccgctaaaaactgtgtatcatgtccgttgcccattgtcgcatctacgacaatatctccttctcccgcggccattttcagcagttctttactgtagggaagaattttcttcaaaatcatagcgctgattcctcctcaagccgctgaaagaactttccttgatagctgcctcggttttctagctctttattaatggcgccaagcacttcccatttgttgacgctccacattggcccgatcatcaactcaatcggtccgtcacctgtaatgcggtggacgatcatttcaggcggaatgatctcaagctgatcgcagacgagctgcacataatcatcttgagaaagaaattccagctttcctttttcatattgcttgaccatcggcgtgcctttcaataggtgaagcagatggattttaatgccctggacgtccaaatctgcgacggcctttgccgtttccatcatcatgtcccggtcttccaaaggcagcccgttgataatatgcgagcagacacgtatgccgtgttttcttaatttattgacgccttccacatagcagttaaaatcatgtgcgcggttgatcagaagtgcagtccgttcatgaactgtttgaagcccaagctccacccacaaatacgtacgttcattcagctctgccaagtaatcaacgacatcatcaggcagacagtccgggcgtgtggcgatcgaaatgccgaccacatcatctaaggagaggacggattcgaatttctcacgaagcacctcaaccggggcgtgagtgtttgtgaaagcctgaaaataagcgatgtacttgccatccttccatttttcgtgcatgcggtttttgatgtcatggaattgcgtaattaaatcatcggcccggttcccggcaaaatcgccggagcctgctgcgctgcaaaacgtacagcctccgtgggctacggtgccgtcccgattcggacagtcaaaaccgccgtcaagcgccactttaaacaccttatggccgaaatgttctctgagatgataattcaatgtatgatagcgtttttccgtatttgaataaggaaaaggattgttctgcatcacaattcatgtgcctccttgcgtacgattgcatcctaaaattgtagcacgcatttcacaagagaacaaatgaatatcgaccataaattactttattgaacaaagtcagatgaggctacaatatgaatgatggatgatttccattaccaagaggaggggttactgtggcaacaagacaatcagtagatgaacatctccagcaatgtatgcaggcctatgattatgctgaagaacagctgaaaatcgcttctaaacaagagcattataacgatcaagaatatagtgatgcacaaatgcagctagaagatgcggtaaatgccttgaataaactatggctgtcgtcaaatgatcagcagagagaacagctgtacagaatgaggcttcagcttcaatctttgcaaaataatatgatcctgcagcaccctcttgatgtgtaggaaaacggacccttttaaaagggtccgttttttttgtaaaaaaaggattgactttgtgagtcaaagtatttattgtattaagtgtactaattgaagtaatacactatagacactaatataaaatcatttatatattgacattaagggaggcagttatgaaacataaaaaacgaaacaaacgtaacgtgccaatgctgattgcggcatctgtgatcgcttgttctttttttcttgttcttgtgatgatcggttttgaatggcaaaaaagtataattgatcatttttatctataaaaggttcagatcgtatagaaagtagggaagtaaatgattcaaatcgatccaagaagctcaacacccatttacgaacaaattattcagcaaatgaaagagctttgtttgaaagggatcatgaagcctggtgataagcttccttctgtcagagaattggcaacgatcattattgcgaatccgaacactgtcagcaaagcgtataaagaacttgagcgagaggggattattgaaacgctgcggggcagagggacctatatatcggagaatgcaaaaacgacactggttgaagggaagatgacgatgattaaagagcaactcaaacagctcatcatcgatgcacactatgcaggggttgagctggaaaaactgcacgaatggataaaggaaatcagcgctgatgtgaagggaggcaaaaaaaatgattgaactacggcagctgtcaaaagcgattgacggcaatcaagtattaaaagatgtttcattaacaatcgaaaaaggagaaatctttggattgcttggacgcaacggatcagggaaaacgacgatgcttcgcttaatccagcaaatcattttcgctgacagcggaacgattttatttgacggcgtagaaatcaaaaagcacccgaaggtcaaacaaaatatcatctacatgcctgttcaaaatcctttttacgacaagtatacatacaagcagcttgttgatatcctgagaagaatatatccgaaatttgatgtcacgtacgcgaatgaactgatgaacagatacgaaattccagaaacgaaaaaataccgtgagctgtcgacaggcttgaaaaaacagctgtcgctcgttctgtcgtttgcggcgagaccggcgctgatcctccttgatgagccgacggatggtattgatgcggtaactagacatgatgtgctgcagctgatggtcgatgaagtggcagagcgtgatacgagtatcctgattacgtcccaccggcttgaagacatagagcggatgtgcaaccgaattggctttcttgaagataacaggctgaccaacgtcatggatcttgatgaattaaaagaagaatacatcaaaatacaaatggcgtttgacacagatgtcaatctggccatcagagagcaaaacattccgatgctcgatcaggccggcgtgttttacacagtgctgataccgaaaagcgatgaggagaaaaagagctttttgagagagctgaagccaaaagtatggaatgagcttcctgtcaacctggaagaagtgttcattgcgaagtttggagggaagcggagatggtagaccgaggtctcctctatcgagagtggaaacagaatcaagtggtgattttgctaagtattgcgtttttagtgctggcaaatccgctttctatcattaatacgtatttgtcttatcaagggtgtctggctcatcaagacccgcaatattgtgaatttattgtgaattatcataggagcaatctaatagatatcaactgggtgccgggggtcattttggcggtctgcttcctcggaatggagcgttcgaaaggcacgatggattttatattaagcctcccgtataacagaagccaaattttccagacgaaattttggttagggggcattgtgattgtgatgtcacaattgattggctttttacttgcgtggctgctaattcttgtttatagccctgaacacgtctacttttttgagcacagcagcgttggagtaattgtgattagttttatggcttattgtttgttgatggctgctggtgcattaacggggagtgtttttgcccagttattaacggcatttgctgctgcggcattgccatatttaattgtcgcattaccgcttggaaactttgaagttgtttttggtgtgagtatatgggaaatgttcccttcccctgaggcgtatttctctctgacaagcaatttattatatcttgtgcccattggttatgttgatagtgactggcttatccatagtaaatatattttaatgattccagctgccatgagcattctgttttacttggttggtttgataagcttcaaaaagcttccaagtgaacgaaacggacactttttcttatggaacagattagaccgtccggtgcaaattctggttatggcttttggtattcttggatttggtttgtttggatactataccggacattccattattggttatattttgggtatgatcattggggcagtggctggattctttgtgagctacttctctatatataagaaaacaaaagtgtaagaaatgccttaggtttggagggaagtgagttgccggattccggactgctttacaaagagtggcggcagaataaagtcgccttagttatcaccattttggcttttatatttggtaatccattatcaattttaaatatgtatctcatctatcaaggctgtgtcactggaaaagaaaattgggtcggcccctgcgtattcagcgttgattatttaaacagctcatttatctcattgttttggatttggggagtcgttttggcggtcagccagcttgggattgaacgaagcaagggcttttttgattttacattaagccttccttatacacgagggcagatatttaacgcgaagttctttaccggcggaatggtgattgtggtgccgcagctcataggttatgttttgtctgttttgctgatcatgcttttgaagccagatcaggccgtttattttcacaattacagccttggaatgatcattgtcagcatgctggcttattcgcttgttatggccggaggagctttgacaggcaatagtttcgcacagcttctagtctcatttaccgtggccatttcgccgtttttactcatcagcctgcctgtgatcaacctcgagatccttattggcggatcaatcgattttatccatggtccagtacctaaatgggtgcagtatttcattccgataatttatgtagactcgaaatgggctgagaattcaccatattatttagtcattccggctatcatgactatcatttttttcatcatcggctatattagctttgttaaaatgtctaatgaaagaaacggatatttcttcttatggaagccgcttaaccgcccggtgcagatcatcgttattatcataggaatcatgggcttcggctattttggatttactgcaagcgagagctttgccggttatctcattggcatgggtacaggtgcggtaatcggtttcttgattagttattttgcgatttataaaaaaatgaaacttttgtaagggagagagaacatatgattgatgttcagcatatcgaccattctttcacgatcggaaaaaagggccgtgagaatgaagttccagtattgaaggatgtttcattacgtgtggcgaaaggtgagatcgcctgtattgtcgggcgaagcggctcagggaaatcaacgcttttgaatttgatttccggctacatatcgccgacaaaagggcggattgtcattaatggcactgatgttacggggtttaatgaaaaggaatgggcgcaatttcggcttgaccattttggttttattttccaaagttttcagctcatcccgggtttaacgacgtatgagaatgttgaaatgccgctggcgttaaaagggatcaagccctctgagcggaagcaaaaggtgcaggacatgctgaaacgcgtcggtctggaaaaccacgccgctcattatccgaatgaactgtcaggcggccagcagcagcgtgtcagtattgctcgagcattgattttaaatccttcgattatcttagcggatgagccgacgggaagccttgattcagaaacggaacatgaagtgctggaattgatccagcagctgaatcgtgagcgtggcattacatttgtgatcattactcacgatgatgaagtcgcttctatcggacattcaaaatttcagcttcatgatggtgtgctaaaaggaggaattaccgttgaggtttaaggatcaggttcattttatcagaagaaatatgaagaaaaacagacttcgcgtctttatgacgattcttgcgacaacaatggcgtgtgcgtttttggttgtgctgtcgtccgttggatttgggattcaaaagacaattacagatatgacaatgagccagcagattgtaacgaaagtcagtgtaatgggcaaggaaggagacaagccgattaaaaaagctgatttagagaagtatgatcacgtaaggtcagttgtagaaagaacgcaagtgtatgaaccaaacaaagctactttaggcaatcgtacaaatgaaagctcaaatctcatttttactaatatgaatgatgaattaaaggccaatatggaattggaaaagggaagagtcgcaaagtcggaaaatgaaatcgtagtaggatacgacttcgcaaagagattattgacgaaaaaagaatcggaagaatataacaaaaaaatcgaagaagcaaaaggaaatccagaagatataaaagaaccaaagggctatacgaaagatattctgaacaaaacaatagaactaagtgtatcgaagacagatcctaaaacaggggatgttacaaaaacaaaaacatatgactttaaaattgtcggtattacaaaaaaaccatctcaagactggatggaggactcaaacatttttatcagtgatcaattcaaaaaagatttttcggaattcttagatttcaaaggcggaaatgttgaaacgaacattggcgtttttgctgataagtttgagaatgtggagcagctgacaaatgatctaacagatgacgggtactatgtcacatcagtgactaccgaacttgagggagccaataccttcttcatggtcttcaaaatcggactgatctttgtcggatgtatcgcagttatcatttcagcgatcggcatttttaacacgatgacgatggcggtgacagagagaacgcaagagatcggcattatgaaagcgattggggcgagcccgtcaatcattcgccgaatgttcttgatggaaagcgcgtatatcgggattttaggctgtgtgattggaattatcatttcctacggcgtgagctaccttgtcaacctggccgttccgatgattcttgcggcgacaagcggtggcgatgcgggcgatttgaattacacattctcctacatcccggcgagccttgtgatcattgccgttgtgatttgcggaggggtcgcagtcatttccggaatgaacccggcgagaaaagcaacaaaaaccaacgtgctgacagccttgagaagagaactataatgtgaacgagccggctgagacagccggctttttctatagcgcatgctggcgttttgctatacacttgataaaaaaggaaaaagtgcggtgagtcgattgtttaaacttttgctgattgaagatgatgaatcgctgtttcatgaaatcaaggatcgtttaacgggatggtcctatgatgtatacggcattcaggatttcagtcaggtgctgcaggaatttgcggcggttaatcctgattgtgtcattattgatgtgcagctgcctaaatttgacggttttcattggtgccggctgatccgctcccggtcaaatgttccgattctctttttatcctcccgggatcatcctgctgatatggtgatgtccatgcagctcggggcagatgactttatccaaaagccatttcattttgatgtgctgattgcgaaaatccaagcgatgttccggcgtgtgcaccattataatacggagccgaatacgattaaaacgtggtgcggcgctgctgtagacgcggagcagaacctcgtcagcaatgacaaaggatctgttgaactgaccaaaaatgaaatgttcattctaaaacaattaatagagcaaaaaaacaagatcgtcagccgggaagagctgatcagaagcttgtggaacgatgagcgttttgttagtgataatacgctgaccgtcaatgtcaatcgccttcgaaaaaaactggacgccctgcagcttggtgcatatatcgagacaaaggtgggccagggctacatcgcgaaggaagaggacaagttctatgattaaagcattccttatcgaaaggcggagctggattgccgcgtttttgtttcagcaggctttgatgctgttcattgcttttgtcgatccttccatatcatttgggaatgtactttatatggtgtatttgtgcatcttgttttttatcatattcctttggttccgctatcggaaagaaacagcgttttataaaagcttgaaaacatgggagaacaatctcgatgtgacagccataaatgaaccggaaacgccgtttgaagcaatggttgaaagaagcattgccgggcaaacagaacacttgaagcagaccgcagcacggcatcgcttagcattggaaaatgaaaaagatgagctgatggcatggatacatgaggtcaaaaccccattaacagcgatgcatttaatcattgatagaatggaagaaaaagcactgaaatcccagctgtcatatgaatggctgcgtattcacctgcttcttgatcagcagcttcatcaaaaacgcatttcatttattgaaaacgacctgtcagtagaattcattcagcttcagcctttgatctttaaagaaatcaaagatttacaatcgtggtgtatccaaaaagggatcggttttgacatacagctcgatgccaaagaagtgctgagcgatgcaaaatggctggcgtttatcatcaggcagctgctgacaaacgcggtgaaatacagcgaagcctctgaaatcgagatcaaaagctttcaaaaaggggaacagacgcagctccaagtgaaagactgtggcaggggcattgatccaaaagatgtaccgcgtatttttgataaagggtttacatccacaacggatcaccatgatcaagcgtcaactggcatggggctgtacttggcaaaaaaagcagcggcgccgttattgatccttattgatgttgagtcggagtttggtgcggggacagtttttacattaacctttccaatacggaatcaatttgaacatgtcataagcgtgtgacgaaaatgtcacatgcttttcttttttgttcgccgtatcgaaggaaaagcccggcattcctttttataatgagattatccaatataaaggagactgcgtaaatggtgattttagaagcgaataaaattcgaaaaagttatggaaacaagctgaataaacaggaagtgctgaagggcatcgatattcacattgaaaagggcgaattcgtcagtattatgggtgcttccgggtcgggaaaaaccactttgctcaacgttctgtcctcaatcgatcaggtcagtcacggaaccattcatattaatggaaatgacatgacggctatgaaggaaaagcagctggctgaatttagaaaacagcatttaggctttatctttcaggattacaatttgttagacacattgacagtgaaagagaatatccttctgcctttatcgatcacgaaactatcaaaaaaggaagccaatcgcaagtttgaggaagttgcaaaggaactgggaatatatgaattacgggataaatacccgaatgaaatttccggcggccagaagcagagaacatccgctggaagagcgtttattcatgacccgagcattattttcgctgatgaaccgaccggcgcgctcgattcgaaatcggcctccgatctattaaataagctgagccagctcaatcaaaaacgcaacgcgacgattattatggttacccatgatcccgtcgctgccagctactgcggcagagtcatttttattaaggacgggcaaatgtatacacagctgaataaagggggccaggacaggcaaacgtttttccaggatattatgaaaacgcaaggcgtgttaggcggggtgcagcatgaacattaatcagctcatcctgcgaaatttgaaaaagaatctccggaattactatttgtatgtgtttgcgctcatctttagcgtggcgctttatttcgcctttgtcacgctgcagtatgatccagcaattaacaaagtgaaggcttcaattaagggagctgcggctattaaaaccgcttcgattttgcttgtggctgtggtggcgatcttcattttatatgccaatacgatttttattaagagacggagcaaagaaatcgggctgtttcaattaattggaatgacgaagcataaaatttttcgcatcttaagtgcagaaaatgtcatgctgtatttcggttcattagcgatcggggtagcggccgggttttcgatatcgaagcttgtcttgatgattctgttcaaaattgtcgatgtcaaagcggatgcgaaactgcatttttctgagcaggccttggtccaaacggtcattgtgttctgcggcatttaccttttgatcatgatcatgaattatacgtttatcaaaaaacagagtattttatctttgtttaaagtaacgtcctccactgaagacaaagtaaagaaaatatcatttttccaaatgataatcggcgctttaggcatcgtgttgattttgacaggatactatgtgtcttctgagctgtttggcggaaaatttaagaccattaatgaactgtttggtgcgatgagcttcattctggggagcgtcattatcgggacgtttttgttttataaaggatcagttacgtttatctcgaatatcattcgaaaaagcaagggcggctacttaaatatttctgaggttctgtcactgtcatcgatcatgttcagaatgaaatcgaacgcgctgctgctgacgattattacaaccgtttcagcgctcgccatcgggctgttatctcttgcttacatctcgtattactcgtcggaaaagaccgctgaacaaaatgtagcggctgatttttcattcatgaatgagaaagatgccaagttatttgaaaacagtttgagtgaaagcaacatctcgtttgtaaaaaaagcaacacctgtcctgcaagcaaatgttgacattgcaaatatcatggatggaactccgaaagagatgcagggcgatcccggcaatatgcagcttgctgttgttagcgacaaagatgtaaaaggagtcgatgtggcggctggagaagccgttttctcaggatacaccgacttgctgcaaaaaataatggttttcaaggactctggtgttattaaagtaaaaagcaagcatgaggcgcagccattaaaatataaaggattaagagaagaatttcttgtatcctacacgtttacaagcgggggcatgcccgctgtcattgtggatgacagcctgtttaaacagctgaacaaggataaggacccccgcattcagctggcgcaatctacatttatcggcgtcaatgtgaaacatgacgatcaaatggaaaaagcaaatgagctttttcaacaggtgaacaagaaaaacgagcatttatcaagactggatacaagcgctgcgcaaaaatcactgtttggtatggtgatgttcatcgtcggcttcttagggttaacgttcctgattacatcaggttgtatcctttattttaaacaaatgggtgaaagtgaagatgaaaaaccgagctatacgattttaagaaaactcggttttacgcagggcgacctgataaaggggatacgcatcaaacaaatgtacaacttcggcattccgctcgttgtcggcctcttccacagttactttgccgtccaatccggctggttcttattcggatcagaggtatgggcgcctatgattatggtgatggtgttatatactgcgctctactccatttttggttttctgtcagttctttattataagaaggtcattaaatcgtcgttgtgaaacagaaaaagctccagacattctggagctttttgtttatcgttttggcgcccgataaccggcggcttcagcttcttcaactgagcaaaacatttcagccggatcggttgtccggtcgtagtatgtactgcctggcgtgtggtagatgccgtttttgcttcctttgatattacagccttctgctttgtcagctgttttggtttcatcacttttactcgtattgtttgaagaacttccagtgtcttcatgagaactggcagtttggctttccgtctcttttaattgattttcaagctttgttttatcttgtcggagtgtttcattttcagcctttgccgtttttgcatcttctttgagctgcttttgattttcttgaagctctttaatctcagcttttaatgatttctgagtcttttttagatcgctattttcgtttttaagcttttcaagcttgtcttgatcttctttgttgtcttttaatttctttgcttcggagctgacagatttatattctttctcaagttcttcatgctcttttgtgaggtttttatattcggcgtttagcgctgaatattttttctcggcatttgctgcggaagtgtcaggttctgccaatgctgccccggtaaagagcagcacaaggcctccaatgaaaagcggccaaaaaagtctcttggagaaacgtttttcctttttcagtacatatctgacaaggtgatataatccatagcccagtgcaatgagacatgccagaaaacctaagaatgctaataccatttccataatatgacccctttttctatttattttacatttttcaaacaatatttgttagattttttcacgctcatcagttgaaaaatgtgagagagacagatagaatgaatgtgctatgataactggattcgtacggagccgttttaggtttcgtttttttcatgagcttttttaggtaagaaagggggatgagtatgccgcgtgctcttaaaattttagtcattggaatgtttatcaatgtgacgggtgcttcttttttatggccgctgaatacgatttatatccataatcatttaggaaagtcgttaacagtagccggacttgtcctgatgctgaattccggcgccagtgtggctggtaatttatgcggaggttttttgtttgataaaatcggcggttttaaatcgattatgcttgggatagccattacgttagcaagcctgatgggtcttgtcttttttcatgattggccagcctatattgtgctgctgacgattgtgggctttggctccggtgttgtttttccggccagctacgcaatggcgggatcggtatggcctgaagggggaaggaaggcatttaatgcgatatatgtcgcgcaaaacgcgggcgtggccgttggttcagcgcttggcggtgtcgtggcgtctttctcgttttcatatgtatttttggcaaatgccgtattgtatctgatctttttctttattgtatatttcggatttcgaaatattcagacgggcgatgcatcccaaacgtctgtgcttgattacgatgctgtgaacagcaaagcaaaatttgccgcactgatcattttaagcggaggctatgtactcggatggctggcttattctcagtggtcaaccacaattgcttcgtacacacaaagcattggaatatctctttccttatacagcgtgctgtggacggttaacggaattctcattgtgctcggccagccgctcgtcagttttgtggtgaaaaaatgggccgagtcgctaaaagcgcaaatggtcatcggctttatcatttttattgtgtctttcagcatgctgctgactgcaaagcaatttccgatgtttctcgctgcgatggtgatcctgactattggagaaatgcttgtttggcctgctgtgccgactattgccaatcagcttgcccctaaagggaaagaaggcttttatcaaggctttgtcaacagtgcggcgacaggcggcagaatgattggtcccctgttcggaggagtgcttgtcgatcattatggcattagggctcttgttttatctctgttggtattgctgctgatcagtattgccacaacgcttctatatgacaaacggctaaaatcagctaaagaaacaaataagcaggcatcaatctcttcataataaaagatcccgctgggtgagcgggatctttttacataatcggaagcactttaacagcatcctttacatttgaatatgttttcagcgacgaaaaattggcatccagtttattcattttcatggccaattcaggcttaatgccggtaatgattaactcagttccggtcaatttcagcaaatggctcagcttgaaaatttggtcggccgtttgttcgttcacttgggccaatccggataaatcaatgatcaaataatcatctttggatgttgataagatattcgtcaatgtgcaaacgatggaattaaatcgctcctctgtcaggtttccgactagcggaagagccgaaatgccattgcgaatcgggacaataggagttgaaagtgcagtaatttccgtgagggaatcctcgagaagcttttcatactctttttgcttggtgatgtctttctgaattccgacaaaatacgttttatcctctatttccattggatcaatatttaattcattccagaacatcgttccgtcttttttgtagttttgaatctgaacggtgaccggttctttattttgtaaagcggttctgatgttgtccacttctgcaggatctgtgtgtttcccctgtaagaagcggcagttctttcctaaaatttcctcggtctcgtagccggtcatttgaacaaagccttgatttacgtagataataggattatcttcaagtgcgggatctgtaattaccacaccgactcgcacgtgatcaagcgcttttttgatgacttccagctgtcctggtatcccaaatgattgaaaactagccatataaatcccccttaggccgtcagcttgctatgcgaaagcctgatattcccctttttaaaatgaattctacagtaaccgtagcacaacacatgttctgattcaagcaagtgcagtttgttgtttgtcattagggcttgtcctcgtatacactaaaaataagaacagaatttgaacatatgaacggaaaggttttctacatgctaaataggtgactaggtcaatgtcactgggtgaaaaatgaatccaatgcatcaagcttaccgatcatgtgttcacatataatggaagaaacaagctttttacagatttgccggtatgtagatatcgaaaatcatcggaatcgtttaagggggctggatggcctgaagtcgctttacgaaataagggctttaggaaggtgatgatgaagatgctgcatcaggtactcattgcttgtgtaattggaggaatcatggggattctcggtcatgtgaaaaagagaggcaggctggagaagcccagaatgacgaagcggtttatctaccttggatttttggaagattggtttatcggcatgacggcttccattttacttgtattatccgctgaccccgattcaggaattcaacttgtcatcttatccattatctcaggctacggcggtgaagctgttctcagaagttttgactttgtgagagaactgaacagcggcggcgaaccggccgagtccaaacgtcaaaccaaaactccacccgaataattgtcctcaatctccgcccgttcagggtacattcccattgtatacaaacctgcttgcacttatgaacagaattctataaaatacagttagattacggttgcgataagaacaatgaagaggagcagtaagaaacagatattgttgcagagagttgacggctggtgaaagtcaatcaagtttgtttccgaactcacctcagagttgcagcggtgaaaagccgctgacgcataactgcgttaaaagtatcaagtgagtgcggcgtatgccgcgctaacgagggtggtaccgcgggaaaacgaaagtctctcgtcccttttagggatgagggagttttttttagtttgggaatattctgaataatcctctccttcccgtcaatacttgaaccatacacgccgtattcaatcagaaggaggtttttactttgagttttcagcacaaagagatagaaaagaaatggcaaacatattggcttgaaaacaaaacatttgccactcttgataataatgaaaaacaaaaattctacgcgctggacatgtttccttacccgtctggagctgggttgcacgtcggccatcctgaaggatacacagctacggatattctgtcccgcatgaagcgcatgcagggctatgatgtccttcatccaatgggctgggacgcattcggcctgccagctgaacaatacgcgcttgacacagggaacgaccccgctgtgtttacgaagcagaatattgataacttccgccgccaaattcaagcgcttggcttctcatatgactgggatcgcgaaatcaatacgactgaccctgaatactataaatggacgcaatggattttcttaaagctatacgaaaaaggccttgcttacgttgacgaagtgcctgtaaactggtgccctgcgctcggtactgttcttgccaacgaagaagtcattgacggcaagagcgaacgcggcggccatccggtagagagacgcccaatgaagcagtggatgctgaaaatcaccgcttatgcggacaggctccttgaggacttggaagagcttgattggccggaaagcattaaagatatgcagcgcaactggatcggccgctcggaaggcgctcacgttcattttgctatagatggacatgatgattcctttacggtgtttacaacaagaccagatacgctgtttggcgctacatacactgtccttgccccggaacacgcattggtggaaaacatcacaacggcagagcaaaaagaagctgttgaagcttatatcaaagaaattcaatcaaagagtgacctagaacgcacagatcttgcgaaaacaaagacaggcgtatttacaggagcgtatgcgatcaatcctgtaaacggagaaaaactgccgatttggattgcggattatgttcttgcatcatacggaacaggtgctgtcatggcagttcctggacacgatgagcgtgattttgaattcgccaaaacattcggccttccggtgaaggaagtcgtaaaaggcgggaatgttgaggaagcagcctatactggcgacggcgagcacgtgaactctgatttcctgaacggccttcacaaacaggaagcgattgagaaagtgatcgcttggctggaagaaacgaaaaacggtgagaagaaagtgacgtaccgtcttcgtgactggctcttcagccgccagcgttattggggcgagccgattccggtcattcattgggaagacggaacgtcaacagctgtccctgaagaggagctgccgctgattttgccgaaaacggatgaaatcaaaccgagcggaacgggcgaatcaccgcttgcgaacattaaagagtgggtggaagtcacagaccctgagacagggaaaaaaggaagaagagaaacgaatacaatgccgcaatgggcgggaagctgctggtatttcttgcgctatattgatccgcacaatccggatcagctggcatcaccagaaaaattggaaaaatggcttccggtcgatatgtatatcggcggtgcagagcatgctgtgcttcaccttctgtatgcccgcttctggcataagttcctttatgatatcggtgtagtgccgacgaaagaaccgttccaaaagctgtacaaccaaggaatgattctcggtgaaaataacgaaaaaatgagtaaatctaaagggaacgttgtcaaccctgacgaaatcgtgtcctctcacggtgctgatacgctgagattgtacgaaatgttcatgggacctcttgatgcttcaatcgcctggtctgaatcaggattagacggtgcgcgtcgtttccttgaccgtgtatggcgcctatttgttgaagaaaacggtgagcttaatggcaaaatcgttgaaggcgcgggtgaaacattggagcgcgtctatcatgaaacggtcatgaaagtcacagaccattatgaaggccttcgtttcaacacgggtatttcccagctgatggtctttattaatgaagcttataaagcaacagaactgccgaaagaatatatggaaggcttcgtgaagcttctttctcctgtcgcgccacacttagcggaagagctatgggagaagcttggccattccggcacaattgcctacgaagcttggcctgtatatgatgaaacaaaacttgtggatgatgaagttgaaatcgttgttcagctgaacggaaaagtaaaagcgaaattacaggttcctgccgatgcaacgaaagaacagctggaacagcttgctcaagcagatgaaaaggtcaaagagcagcttgaaggcaaaacgattcggaaaatcatcgcggtgcctggcaagcttgtcaatattgtggcaaactaagcctagaaaaaatcccctttgccaaaaggggatttttttcatcagtctcagaatagcaatcgttcagctgactttgatatactgaacatgatcactgtgaataggagtgttttctttggaaataaaagaaatcagcacagccgctttgaaagaaaaaattgaggcggacgaagaattatatttaattgatgtcagagaagatgaagaggtagcggaaggcatgatcccgcaagccgttcatattcgcatgggggatattcctgaaaaaatggaaacccttgataaagacaaagagtacgtatttatctgccgctcaggaatgcgcagcatgaacgtctgcaagtacctggatgagcaaggctttaaaacagtcaatgttaaaggcggcatgatggcctgggaaggcgaaacaaaaccaaaaaactaggggacagcggtcccctagtttttatttgtattccggaagccaatcgccgtgtgctgcaaataaatcgtcacacatggagatgatgtccttcatggaaagctccgcgcttgtatgcggatcaagcattgcagcttggtaaaccgcttcttttttccgtgtgacagccgcttcgattgtcatcagctgtgtattaatattcgtccggtttaaggcggcaagctgctcaggcagttctccggcgaagcacggtgtaattttttttctgtcggcgacgcatgtcacttccacaaccgcttttgaaggaaggttggtgatcagccctgtattcaagacgtttcctccgaaggtgaatggttcgtttgtttccattgcttctataattcttgaaccatattcctttgagcgttcgtgcgtaaggtttttattgttgacgatgtcatcccgcattttctcccaattttcaatctgcttgacgcaccttctcggatattcgtcgagcgggatttgcagctcgctgatcaattcagggtaattccgtttaataaagtatgggtgatactctgcgttatgttcggacgattccgtgacataatagccgaacttatccattaattcaaaccgcaccatatcatgatgctttgttttttgtttttctttcgctctccttttgatttctggatataaatctgtgccgtcttttttgacttccaaaagccaagccatatgattgattcctgcgatgcgttcctcaattccgtcatgctccattccgagagctttaaataaatccttcgtgcacacttgaacactgtggcagagcccgattgttttgatattggtatagcggagcatggcgcctgtaagggtggccattggatttgtatagtttaagaaccatgcgtcagggcacatttcctccatatcttttgcgatatcaaataagaccgggattgttctgagagatctgaatatcccgccgatgccgactgtatcggcgatcgtctggcgcagcccataccgtttaggaatctcgaaatcgatgactgtgctcggtttgtatcctccaacctgaatcgcattgatgacatagcctgcgttttgcaaggcgagttttctgtcatcatagctgttgatggccacacttgggttataacggtctcttagattttcgagcatgagctgggattcctgcaggcgtttgggatcaatgtcgtaaagagcgaactcaaatccattcagtgcctctgttaacaggcagtctcccaaaacatttttggcgaaaatcgtgctccctgcaccgataaatgtaatctttttcatattgcttcctcctttaatgttaaccctttaccgctccggaagacaggccggcaataaagtatttttgcagcgccaaaaacagaacaaccatcggcagcattgccataagtgccgctgcggcaactaaatgaaggttgtttgcgttttctccgaaaaaacctgccatggctactgttaatgtctgaaccttttgatcttgtaaaaagaaaatggcaaattgatagtcgttccaaataaagacacaagaaataatacagatggtcgcagtgatcggcttcaggagaggaaacacaatcgtaaaaaagattttcagcatgcctgcgccgtcaattcttgcggcttcttcaagctcttttggaatggtcgatcggataaagcctgaatacaagaatacggttaacggcatgtaagccgctgtattgatgaaaatggcgattgcgtgtgtattgaccatcccggcgtccacgaccattcggtacaaaggaaccatggacgttaacggagggatgatcataatggaaatcagcaaggcaaaaacggctttattcagtttcgtttcccgccgggcaagcgggtaggcggcaagtgagcctaatataattaataacaaggcagaaaaacctgtgatgatcatggtgtttataaaagagttacctagcgaagcgcgctcccacgcctctgagaaattgtgaaaggagatgttggctggaaatatccatttcgaactgtagtctccttttgctttcaatgaagtggtcagcaggatataaaaaggaataaaatgcgcacaggccacaatggcggcaagaagcgtaatgatccgcatgttttttgtacggacggctctcatgacatttccgtctcctttcttttaaagtacgcaagcgcgcaaaagctgatgatcaaaatgacaaatgccataaatatgccttgcgttgcggcatagccggcatcctgccgtttgaaatacaaatcatacataaacgtggacatggattgtgacgcatttccgggaccgcccgcggtgagtgcaatgatgacgtcaaacagctttaagcctccgataatattgatgaccatattaatggtaatggagggcattaacagcggcagcgtgatggtaaaaaactgctggccttgtttcgcgccatccatttgcgccgcttcatagtagtctttcggaatactttgcagaccggctaagtagacaaccatagcgatcccgacatattgataggtgttaatcatgacaatgatccatggattgagcgagggactggcgagcgcattaatagggctgatgccgaagaccccgagcaaatcgttgagcgcgcctccgtcataggagaagaaaaagtaccaaatgtagcccataatgagcgggctgatcatcaccggcaaatacacaattgttcttgttaccgctttcgttttaatgctttgattcaagagcagagcgtacagaagcccgaccacattttggaaaaaggtgctgccaagcccgtaaagcagagtgttttttaagatatgccaagtatcaggatcagaaaacagcctttcatattgcgcgaatccaacccattggtagacttgtgaaaatccgttccagtttgtaaaggtaatcaatgtgcctttcacaaacgggtaaatcataaagaccagaacggagagcaaagcaggaatgtacatccaccaaagtgaggactgcttttttggcttaacctgtttcacatgaacgtcccttgcgatctcactcattgttttcagctccctgtgtttccgattgctcccggagtcgtttatattctcttcccagcttctgcgaaatttcttgaggccccaaaatgtcagccgcgagctcctgcccaaccgtgcccaggacatcccacattccgtttggcaagtataaacggtcgaagtaaggctcgactttgacatcttgataatgctcataatcgtttgcgtagaaaatatcagctttcacattggtcagccctgaaggaagcgatgtggcttcagccatttgtttggcattggccgggcgggccataaatgcgataaaatcttttgcctcttttaattgaggcgaatctttccatgctgcaagggtgtagcgttcaccgccgatccatatcgggtcatcaccgggatggatggcaggtgtcgggataatgccgacctcgacgttagagttgatctgggcaacgtcttggccgagggtgccgccttgcattgtaaaggcgattttgttttgggccattaattcgatgagctgtgatttttttgccgttacggcgtcgatattgatcaatttttctttctgcatttgtttgaggatttttgataagtaagtgaatttattccattgaaaagtgccgttgatgagctgttttttttcattatgggcagggtctgtgatgagaagaggtgtagcgaattggtcgtaatattgggcgaatgagcttttgtcatatccggcaaaccagaagggaacaatgcttcccttgctcttttctttaatcgttctcagtgctttgataaagtcatccatggtttccggcggagcaatgccgtaacggtctaaaatattgcggttatacgccagaccgtcttttgcctgattgatcggataggcatacacctttccgcttttatttttgaggatgctgtttaaattgggatcaagatcttgagtccattccatatcccggagatccgctgtatattctccgtacctgattttcccccagccatgtgtatcgaatagatctggcaaatcattggccgccattctgacacgcatcatattttcatagtcattgcctgggaaatgaaggctgacatgtatgtcactgtgttccttttcgaatgctgccgccagttttctgaacgtatctctttcactgtcggttgacattgtagaataaatggttaacgtcttttttgcggtatctgctgagcttttctctgctgaacacccgggcagaacaagcagtataagagagagaaataaaacaaaagtgtgtttcatcttttcctccttatcatcgtgatgaatctttgcttatgtcacctccttagctgtacatccgcagctttgtcttacgattaatgttgtaggcagggtgacatggtgaggaagcgttcggccattgagacggtcaagcagcagttttacgcctgtccggcccatttcctctgtgtataccttcaccgtcgttaaaggtgtgctggcaaattcagcttcctcaatgccgttaaagctgacgattgcagtatcccgcggcacttgcagtccggcttcctgcagcgcttttaatgcgccgatcgccatagaatcgctggcaataaagaatgcttccggcagatggccttgatcgattgctttcttcatcaggcgatagccctcacgcatgctgtattctccgatcagcacatgctcaggctggggggtggctgactccaaaaaagcggtcaggcgtttgtcttcaatcgttctgcgaatgctttggccgtccttcagcgtatgctctttttcttgaccgccaatgtagcctaaccgtttgtagcctaagtcgaaaaggtgatcaatcgcctggcgtgaagccgattcaaaatcgattccaatcgaatcgtatgcttgcggatctggtgaatgattgataaatacggcatgctccagccttccgctgatatgcttaaccgcttcatcatgaacacggccaatgacaatgacaccatccaattcccgaaagatatgttcctgaaatgagccgagatgaatcgaatttgtaataaaaatttcctgttcaaagcattccttttcaatgcctttccgaatggaagaaaaataagggtcctgcctttcctgatcaggggacagacagctcagcacgccgatcagcggctgggcccgctgtttttgcccgcgggcttttcggcgtttggcaacggtttgataaccaagctcttcagcgatgttgatgactctttgtctcgtttcgcccgcaacagaaagcgactcatcttcatttaaaattctggacacagttgcgctggaaactttagctttcaaggcgatatctttaatacgaaccatgggtatccctctcatctatttagtaaaatattaactcatctgtttttgataaattgatactatcatataaaagtaagcggttacaataattattttcggaatatttcgttatatttactaaatatttagtaaatgatgtgatttatgttggaaaaataaaggggaacccagatctgtctcgtaaatgtgaagtaagcgaattaggaagggtgatgggatgagagccgaaagacgaaagcaactgtttcgattgcttggtgatttgcctgatcggaggccaatcagtgttgagacattacgtattgaagaaagagaagaaaatatcgttgaaacgctcctgctcgatttaaatggacatgaaaaggcgcccgcttattttgtgaagccgaagaaaacagaaggaccgtgcccagccgtattgtttcagcattcgcatgggggccagtatgataggggaaaaagtgagctgattgagggagcggattatttgaaaacgccttctttttctgatgagcttacttcactaggatacggcgttcttgcaattgatcattggggatttggagatcggcggggaaaagcggaaagcgaaatatttaaagaattgcttctcaccggaaaagtgatgtgggggatgatgatttatgacagtttaagtgcgttggactatatgcagtcacgctctgatgttcagcctgacaggatcggaaccatcggcatgtctatgggaggtttgctggcgtggtggacagcggcgctcgatgaccggattaaggtgtgtgtggatttgtgcagccaggtggatcatcacgtgctgatcaaaacacagaatcttgacaggcacggcttttattattacgtcccatcgcttgcaaagcatttttccgcatcggagatccaaagcctgatcgcgccgcgcccgcaccttagtcttgttggtgtacacgaccggttaacgccggccgagggcgtggacaaaatcgaaaaagaattgacagctgtctatgctggacagggagctgctgattgctaccgagtggtccgttctacttctggacatttcgaaacagcagttatgaggcatgaagctgtccggtttttgcaaaagtggctgtgactgttaaaagaaatcgaaaaagaccgttttgtgtaaaaacggtctttttgtttccttttaaccaactgccataaatcgatgctttcttctattgacagaaacaggagagaataatatattctaattgttaaccttaaaatataattggttaacaattaaggagagaagcactacacgttcttcagttatcagtgaaagggcgagaaatgatgcaagaagaaactttttatagtgtcagaatgagggcttctatgaatgggtctcatgaagacggcggaaagcatatatccggcggagaacggcttattcctttccatgagatgaagcatacagtcaatgctttattagaaaaagggttatcccattcaagaggaaaacctgattttatgcaaattcaatttgaagaggtacatgaatcgataaaaaccattcagccattgcctgtgcatacgaatgaagtgagctgcccggaagaaggacaaaagcttgcccgattgttattggaaaaagaaggcgtttcacgagacgtgattgaaaaagcatatgaacaaatccctgaatggtcagatgtcaggggtgcggtgttgtttgatattcatacaggaaagcgaatggatcaaacaaaagaaaaaggggtgcgggtctccagaatggattggccggacgctaattttgaaaaatgggcgcttcacagtcacgtgccagctcattcaagaataaaagaggcccttgcgctcgcttcaaaggtaagccggcacccggcagccgttgcagaattatgctggtcggacgatccggattacataacaggctatgttgcgggtaagaaaatgggctatcagcgtattacagcaatgaaagaatacgggactgaagaaggctgccgagtcttttttattgatggatccaatgatgtaaacacgtacatacatgacctggagaggcagcctattttaatagagtgggaggaagattatggctcatgatttgataggaaaaagtaaaaagcacctctggctgccatttacccaaatgaaagattatgatgaaaaccccttaatcatcgaaagcgggactggaatcaaagtcaaagacataaatggcaaggaatactatgacggtttttcatcagtttggcttaatgtccacggacaccgcaaaaaagaactagatgacgccataaaaaaacagctcggaaaaattgcgcactccacgttattgggcatgaccaacgttccagcaacccagcttgccgaaacattaatcgacatcagcccaaaaaaactcacgcgggtcttttattcagacagcggcgcagaagcgatggaaatagccctaaaaatggcgtttcagtattggaagaacatcgggaagcccgagaaacaaaaattcatcgcaatgaaaaacgggtatcacggtgatacgattggcgccgtcagtgtcggttcaattgagctttttcaccacgtatacggcccgttgatgttcgagagttacaaggccccgattccttatgtgtatcgttctgaaagcggtgatcctgatgagtgccgtgatcagtgcctccgagagcttgcacagctgcttgaggaacatcatgaggaaattgccgcgctttccattgaatcaatggtacaaggcgcgtccggtatgatcgtgatgccggaaggatatttggcaggcgtgcgcgagctatgtacaacatacgatgtcttaatgatcgttgatgaagtcgctacaggctttggccgtacaggaaaaatgtttgcgtgcgagcacgagaatgtccagcctgatctgatggctgccggtaaaggcattacaggaggctatttgccaattgccgttacgtttgccactgaagacatctataaggcattctatgatgattatgaaaacctaaaaacctttttccatggccattcctatacaggcaatcagcttggctgtgcggttgcgcttgaaaatctggcattatttgaatctgaaaacattgtggaacaagtagcggaaaaaagtaaaaagctccattttcttcttcaagatctgcacgctcttcctcatgttggggatattcggcagcttggctttatgtgcggtgcagagcttgtactatcaaaggaaactaaagaatcttacccggctgatcggcggattggatacaaagtttccttaaaaatgagagagttaggaatgctgacaagaccgcttggggacgtgattgcatttcttcctcctcttgccagcacagctgaagagctctcggaaatggttgccattatgaaacaagcgatccacgaggttacgagccttgaagattgattcctggttaaacgagcggttagacatagcaaaggaagccggcgtacaccgtaacctgcggtcaatgaatggggcaccggttccagagaggaacattgatggcgaaaatcaaaaggtctggtcctcaaacaattatttagggctcgcaagcgatagacgtttgatcgatgcagcccaaacagcattgcagcaatttgggacaggaagcagcggttcacgtttaacgacaggcaattcagtctggcatgaaaagctagaaaagaagattgccagctttaagcggacagaagcggccctgctgttttcgagcggttacttggccaatgtcggtgtcctttcatccttgccagaaaaggaagatgtcattttaagtgaccagctcaatcatgcaagtatgatcgacggctgccgactttctaaggctgatacagttgtttatcggcatattgatatgaatgatcttgaaaataagctgaatgaaacacagcgttatcagcgccgttttatcgtaacagacggggtattcagcatggatggtacaatcgcccctcttgatcagatcatctcacttgcgaaacgctatcatgccttcgtggtcgttgatgacgcccacgcaacaggagttttaggcgattcgggacgaggaacgagtgaatactttggtgtttgtcccgacattgtgatcggcaccttaagcaaagctgttggcgcggaaggaggttttgcggcaggatcagcggtcctcatcgactttttgctgaaccatgccagaacatttatctttcaaaccgctattccgccagccagctgtgcggctgctcacgaggctttcaacatcattgaagccagcagggaaaaacgacagcttttattttcttatatcagtatgatcagaaccagtctgatgaatatggggtatgtggtgaaaggagatcacacaccgattattcctgtagtcattggcgatgcccataaaacggtcatatttgctgaaaaactgcagggcaagggaatttatgctcctgccattcggccgccgaccgttgcgccgggtgaaagccgtattcgaattacaatcacgtctgaccacagtatgggtgatattgataatttgctgaaaacatttcattcaatcggaaaggagctgcatatcatttgaggggtttttttgtgacgggaactgatacagaagtagggaaaacggttatatccagcggaatcgccgctttattgcgagaacataatagagatgtcggggtgtataaaccatttttaagcgggatatcgcgccatcatccagatagtgatacaagtttgctgaaagatatgtcgcagaccagtctttctcatgaagacattacgccttttgccttcaaggcgccgcttgcaccatacgttgcagggaaacttgagggaaagactgtcaccatggaagaggttttaagccattgggggcggattagagaaaaacatgaatgcttcatcgtagaaggtgcaggcggtatttctgtgccattgggagaggactatttggtcagtcatgtcataaaagcgttgcagcttcccatgattattgtggcgcgtcctcgccttggaaccattaatcatacctttttaactgtcaaatatgcagaaagcatggggcttccaatcgccggaattatcatcaatggaatcagtgactctcctgatgaagatgaaaaaaccaatcctgagatgattgagcgcttatgcggtgtgccgattttaggggttacgccaaagcttgccaacgtgacgaaagaaacggttctacatatggtaaaagaccatatcaatctatcattactgatgaatcaagtgggggtatgagaatgaatcaatggatggaactcgcagaccgggtgctggctggagcagaagtgactgacgaagaggcgctttcaatattacattgtcctgatgaagatattttgctattaatgcacggggcttttcacatcagaaaacacttttacggaaaaaaagtaaagctcaatatgattatgaatgcgaaatctgggctctgcccggaaaactgcggctattgttcacagtctgcgatttcgaaagcgccgattgagtcttaccggatggtgaataaggaaacgctgcttgaaggcgcgaagcgggcgcacgatctgaatatcggcacatattgtatcgtggccagcggcagagggccgtctaacagagaagtggatcaggtcgtagatgcggttcaggaaattaaagagacgtatggactgaagatttgtgcatgtcttggactgttgaagccagagcaggcgaagcgtctcaaagatgccggagtagaccgctataatcataatttgaatacgtcacagagaaaccattcaaacatcacgacctcacatacatacgatgacagagtcaatacggttgaaatcgcaaaagaatcggggctgtctccgtgttcaggcgccattatcgggatgaaggagacgaaacaggatgtcattgacatcgccaaaagcttgaaggctcttgacgccgattccattccggtgaattttttgcatgcaattgatggcacgccgttagaaggcgtcaacgaattaaacccgctgtattgtttaaaagtgctggcgctgttccgttttatcaatccatcaaaagaaattcgcatttccggaggaagagaggtcaatctccgctcattgcagccattagggctttacgccgcaaactccatttttgtcggagactacttaacaactgccgggcaagaggagacggaggatcataaaatgctgagtgatttaggctttgaagttgaatcagtcgaagaaatgaaggccagtttaagtgcgaaaagctgaaagaatcaataaaagcaatcggtatgatgtcgattgcttttatttttgaacagaaaggagaaaatcacgtgacaattgcatcatcaactgcatcttctgagtttttgaaaaacccatattctttttacgacacattgcgagctgttcatcctatctataaagggagtttcttaaaatatccgggctggtatgtcacaggatatgaagaaacggctgctattttgaaagatgcgagattcaaagtccgcaccccgctgcctgagagctcaaccaaatatcaggacctttcacatgtgcaaaatcaaatgatgctgtttcagaaccagcctgatcatagacgattgcggacgcttgccagcggagcatttacgccgagagcgacagagagttatcagccgtatatcattgaaactgtccatcaattgcttgatcaagtgcaaggtaaaaaaaagatggaggtcatttcggactttgcttttcctttagcaagctttgtcatagctaacattataggtgtaccggaggaagatagggagcaattaaaggagtgggctgggagtctcattcaaacgattgattttacccggtcaagaaaggcattaacagagggcaatcatatggctgtgcaggctatggcatatttcagagagctgattcaagagcgaaaacgccaccctcaacaggatatgatcagcatgctcttgaaggggaaagaaaaggataagctgacggaagaggaagcggcatctacgtgcatattgctggcgatcgccggacatgagacaacggtcaatctcatcagcaattcagtcctttgtctgcttgagcatccagaacagcttttgaaactaagagaaaatccagatcttattggtaccgcagtcgaggaatgtttacgctatgaaagccccacgcaaatgacagccagagttgcgtcagaggatattgacatctgcggggtggcgatccgtcaaggagagcaagtctatcttttgttaggagcggctaatcgagaccctagcatattcacgaaccccgatgtcttcgatattacgagaagtcctaatccgcatctttcattcgggcatggccatcatgtttgcttagggtcctcgctggcacgattagaagcgcaaattgcgattaacacccttctgcagcgaatgcccagccttaagctcgcggattttgaatggcggtatcgaccgctttttggatttcgggcgcttgaggagctgccggtgacttttgaataagcctaagaatgtgagtgccaaaaaagtgtcagccccgccgaaaatgggcaatctataaaaaaggggagtgaacatagtgaaaaaagtgctgatcgccggcggaaatggtgtgattgggagactgcttgctgaagggcttatttcagactatgaagtgacagtgcttgataaagatcatttcgatggcaaagcctcttccattcaggctgacgcggcaaattatgaggagctgttgaagaagattccaaaagatacggatgtcatcttgaatttactcgctgttaaaatcaaatacgatattatggacatcgctgagtttgaaaaaatgacggatgttttctatagggcaagctattatctgtgccgtgcggcagcggagctcggcattcaaaagctcgtgttcgccagcagtaatcatgtcacagatgtatatgaaaaagacgggcgctcgctcttaggacgggaaatcacaacaagcgattatccgctgtcaaaaaacttgtacggtgtattaaagctgacctctgaacagatcggccatttgttttatttggaaaataagctatcagtaatcaaccttcgaatcggaacagtcgtgacagatgaaatggatacgctgcatgaaaaagaacggacgaaaaagacactgctttctcaccccgatctgctgtcgattttcaaagccgccattgagaccaacatccggtatggcacttattacgccgtctctgataatccgggccggccatggtccattgaatctgccgtgaatgaacttgggttttcgccacaaatcaatacggctgaacttctgaacgaggaggagaacggagcataatcattttctaagattatgctctttttcttttgttatcggtctcaattcgcggcagcccccgcccggccggggacactgttcaaatgattatagacatggcaatcacagatttgctacattttagacacgatatcgtcacatgctgagctcggtttccaaaaatatgataacgcttacaaagagaggtgagagctatcgcacattcactgaaaaaccgtctgtttgatatgttgatttatggtttcttgctgatgttcgctttaatatgcgtacttccgttcattcatgttatcgcagcatcctttgccacagtagaagaagtcgtgtcgaaaaaatttattttaataccgaccactttttcgctagatgcttatcgctacattttttcaacagatattatttataagagtttgcttgtttctgtgtttgtgacagtgataggcactgcggtcagcatgtttctttcgtcactgatggcttacgggttatcccgccgtgatttaatcggccggcagccgctcatgtttctcgtcgtatttacgatgctgtttagcggcggcatgattccgactttccttgtggtcaaatcgcttggattgctcgattcttactgggcgcttattttgccgacagccattaatgcctttaacctgatcattctgaaaaacttctttcaaaatatcccatcaagcctggaagagtccgcgaaaattgatgggtgcaatgatctgggcatattctttaaaattgtgctgccgctgtctcttcctgcgatcgcaacgatttcactattttatgcggtcacgtattggaacacgtatatgacagcgatcttgtacttaaatgattcagcaaaatggccgattcaggttcttctgcgccaaatcgtcattgtatcaagcggtatgcaaggggatatgtctgaaatggggtcgggcagcccgccgcctgagcaaaccattaaaatggcggtcatagtggtggcgaccatccctgttctgcttgtctatccgtttatacaaaagcattttgcaaaaggagctttgctgggatctgtcaaaggataaagaaatatgaaacggaggggtacgatgggaaacaaatggagggtgcttttgattgtgcttgtactggcactcggcggagtgctggcgggctgtaaaggaactgatcagtcttcggctgaaggcaaagctggcccagattcaaaggtaaagctgtcttggatggcgattttgtatcatcagcagccgccgaaagacagggcgattaaagaaattgaaaagctgacaaatacagaactcgacatcacctgggttccagacgcggtgaaagaagacaggctgaatgcagcgcttgcagccggcaatcttccgcaaatcgtgaccatccaggatattaaaaattcgtcagtcatgaatgcctttcggtcaggaatgttttgggaaatcggcgattatatcaaggattatcccaacttaaacaaaatgaacaaactcattaataaaaatgtgacaattgacggcaagctctacgggatatacagagagcgcccgctttccagacaggggatcgtcattcggaaggactggctggacaatttaaatttgaaaaccccgaaaacgttggatgagctttatgaagtggccaaagcatttacggaggacgacccggacaaggatgggaaagatgatacgatcgggctggcagaccgtaatgacttgatttacggcgcgtttaaaacgattggctcgtatgaaggcatgccgacagattggaaggaatcgggcggcaaattcacgcctgatttcatgacacaggaatacaaagacacgatgaactatatgaaaaagctgcgtgataacgggtatatgaataaggattttcccgtcacaagcaaaacccagcagcaggagctgttttctcaaggaaaagccggaatttatattggcaatatggtagatgcggtcaatctgcgcgaccatgcctctgataaatcgatgaagctcgagatcatcaaccgcataaaaggcccagatgggaaagagcgggtatgggcatcaggaggccataacggcgtgtttgctttcccgaaaacgagtgtgaaaacggaagctgagcttaaacggatcttggcgttttttgaccgaattgccgaagaagatgtctatagcctgatgacttatggcattgacggcgttcattacaacaaaggtgaggacaaaacgtttacacgcaaagaaagccaggtaaaagactggcagactgatattcagccgctgtccgctttaattgccattgataaagcctacttaaaaaacactggagatccgcttcggacggcgtacgaggagctgaccgaggacaatgaaaagattatcgtctcaaacccggctgaaagcctgtattccgcatcggagtcggaacggggtgatgaactgaagaaaatcattgatgacgcgacctacaaatatatgattggagacatcacagaaagccagttcgataaagaagtggaaaaatgggagtcaagcggaggaaaacaaattattcaggaatacgaagaagcgtttaaacaagcaaaataacattggaaaaacccaaaacgcgcaagcggttttgggttttttacatgcttcttttttgctggcggtagtttcccggtgtaatcccttccagctttttaaatgatctgatgaaattttgggagtttttatatttcagcttttcggcaatgtccttgaccgccatgtcggtttcggcaagccagcttttcgccatatggtgtcggtagcttgagacatactcgctgaatgaaattcccatttcttttttgaaaatactgcttaaataatttgggttgtaatgcagcctgcgcgcgatttcgtccagtgtcaattcggattcaaactcatgatggatgatatgaataatgttgtcggaaatatttttgtactgggcatccgcgcgggcgttcactttgtctgtcatcggatcaataaactcattctttagccagttttcggtatcctcgaacgttttcagctcaaaaatttggtcatacagcattttgttttcttcaagctcaaacaattcgatcccgagcacatgcatcagctcaatcacatggttcaaaaaacgggcgatggcgatttgaaattgatacgggttggtgttctgggtgaaaatggcttgcaaaatcgcgtgcaggcatttatccgctttctccttgtctcctgctttaacggcatcgaacagctcatgctgaagctgctttggaaaatgggttttgaaggtttttttctggtcaaggtcttcgtaaaaaatgatcgacttgttttccgctttaagccggtatttcaacgcttctgagccttccgcataggctgttttcgcttttgtcagcacatcaaacggctggctgatgccgatgctgacagacagatgcagctcagcttccgctttttcctgaatcatccttgcagtctcattcagctcagccatgaattcttcttttggcccgctttggttgatcaaaatcgtcgcctgctgtttgtcaactacggcgggggcaagatgtttgtccgtcgggatgcatcgctcaatcaggctgttgacggcaaacaaaagcagatccatatcttttttctcataaggcgtatgattcagtgtgtcaatttggagcacaagcagggcaaggtgccgccaattttgctttaagccgaggctttcaaaacggttatcaacctcctcatccgtcagttttccaagcataagcctgaccataaaatattgctgcagatgagtggcctgctgcttcatcgtttcctcaaggtcgtcatttcggtccttcagctgcttaaagctctgttcaattaactcaaattcattttgaggaggctgttgtttctcttgtatggctccatgtcttgcgaatgattcgtaaagcaccctgatcggcttgtaaaagtggcgggagccaagccaagagaacagcaatgaaagcgttaacaaaatgaggcatactgcaaaagtgatccagccgattgatttggcttctttttttaactcaggcagggaaacgagagaaaaataagtccatgcattatagtcagatttttgataggtgactttataatgaatccggtcaatcactgtttcaaactgtccgctattggccgtttgcgccagcactttttggacaaagccgtcgttatgaagagattcaccaacgtcagacatattgttatgaaggatgatgaggcctttttcatcgatgataaacaggttgttggcgtttgaatagccgggcatatttttgacaagcgaacagctcgggatgcttgcggcggccaatccctttgtatttgtgctgttcaaaggaagctgcttaattaaattgatattgtagcggcagttttctgctgtgccttctttggttgaaatcaaatgattgttttcctcaagcgtccaataggagcgactcgctttttgtttcgtgtacgctgaggctgcttcatgaagagtgtctgtattcaaacggtacaaaccggaattgttcatgtaccattttttcgtataactgactaacgtcatgttggacagatcggtatcaaagctttgcagataattgagctcttggttcacttggttatagatttgaaattggtctgagtgcaaaggctcggacaatgtgcgaaggagaggcggcgaactcacatagtgggttaaagagtgatcgacggttttcaatatatgctcgatgctttgctgggtctgctggagtgtgtcgaatttttcctccgaaacgttggaaatagccgttttctgagagtgctcgtacgaaaacaatccgaccaaaataaccggaatggtgctgagcaggcagaaaaacgtgatcagtttgtagtaaaacttgtattggcttcttttcataaaaccccccatttcataacatccacttcaccttaatacaattaatccaaagattgatagatattgtcaataatcattttctaatatcggtgtctttttttcaggtggaccggctgaacccttgattataaagggataaaacaggatgtgatcatatgattgtagacggacttttgcctgctgcgctacagtgaatgcaagaatccgtgaaaggaggctaggaaaaaatgaaaacagcagaagcgcaagcgccggctgttgatgcagtcatttttaaaaaagaaaaaagaaagcgcttactaatcaagctgattcaacaaaaatatttgtacttgatgattttgccggggtgtatttattttttgctttttaagtatgtcccgatgtggggaattgtgattgcgtttcaggattatcagccgttcctcggcattttgggcagtgagtgggtggggctgaagcattttatcaggctgtttactgagcctacattttttctcttgttaaaaaacacgctcgtgttatttgctttgaacctggccatatttttcccggtgccgatactgctggcgcttctattgaacgaagtgcagattgctctctttaaaaaatttgttcagacgctgatttatatcccgcattttatgtcttgggtcattgttgtatcgctttcgtttgtgcttttaacggtagacggaggcttgattaatgaactgattgtgttttttggcggtgaaaaaatcaattttctgctgaacgaagaatggttccggcccctgtatattctgcaggttatctggagggaagcaggctggtcgacgatcatttatctggcggccattacagcggttgacccccagctgtatgaagcggcgaaaatggacggagcgggacggctgcggcaaatgtggcatattacgctgcccgccattaaaagcgttatcgtcgttttgctgattttgaaaatcggagacacgctggagcttggcttcgagcatgtgtatttgctgttaaatgcgacaaacagggaagtggcggaaatttttgatacgtacgtttatactgcagggctgaaacagggacaattcagctacagtacagcagtcggcgtatttaaagcggcggtcgggctgattttggtcatgcttgcgaatcgtttggcgaagaaatttggcgaggaaggaatttattaagaaagggatgggatcaatggatcaatcaatcgctgtaaaatcgcctcttacgtacgcggaggcattggcaaaaaccattatgaatacgtacacagtccaggagctgcctcctgcaaaccgctggcactaccaccagggtgttttcttatgcggtgtattgcggctgtgggaagcaaccgaggaaaagcggtattttgagtatgcaaaggcttatgcagatctcttaatcgatgattatggcaatctattatttagaagagatgaactggatgccattcaagcgggtctcattctttttccattatacgagcagacgaaggatgaacggtatgccaaagcggcaaaaaggctgcgcggcttatatggaacactgaaccggacgtctgagggcggtttttggcacaaagacggttatccttaccaaatgtggcttgatggcttatacatgggggggccgttcgcactgaaatatgccaatctgaagcaggagccggagctgtttgatcaggtcgtgctgcaggagtcattgatgagaaagcatacgaaggatgcaaaaaccggactcttttatcacgcctgggatgaagcgaaaaaaatgccttgggccaatgaagagacaggctgttcaccggaattttgggcacgttccatcggctggtacgtcatgtctcttgctgacatgattgaagagctgccgaagaagcatccaaaccgtcatgggtggaaaaacacgctgcaggacatgatggaaagcatctgccgctatcaagacaaagagacggggctatggtatcagatcgttgataagggagacaggtctgataactggctggaaagctcagggtcctgcctgtacatgtacgcatttgcgaagggaatcaataaaggctatttagacagagcttatgaaacaacactgctaaaagcgtatcaaggcttgattcagcataaaaccgaaacatcagaagacggcgcgtttctcgtcaaagacatatgtgtcggaacgtcagccggtttttatgactattatgtcagccgcgaaagaagcacaaacgatctgcacggagccggcgcgtttattttagctatgacagagctggagactctttttaggtcagcggggaaatgacaaaaaagatacgtacggctttgtgtgtgatcgtctcagtgctctttttggcatcatgctcaagcaggccggacggaatgcatgtcattctcttttctgatatgcaggctggcgtacaggaaaaaataaaaaaggccgccgagcagaatgccgggaaggtcgatatctttccagcttttcagggaaaactgctgactgaaattaccgcccatgagggagatgttttcatcgtgcctgaagacatgtttcaagcttacgatgatccggaaaattttcagccgttaaacggattgcctcctaaaaaaacatctccttatacaactgttaataaaaaaacaggagaaaaaacgatctatgccgttcagatcgaaaaagggaaaaaacagctgaacggctattcttttcgattgaatcgcgatatggtggcgtttatccctgtgtatgctgaaaaaacagaggaagcgctgcagctgatttctcaactaactgaagcccgatagaggtgaggatattgaagaacatcgtcttttgcggattgagcagcagagtattcagtatgtttatcaaaccgctgttggagcggttttcaactcattatgagattacgggattgctggatgccgatccgaaacgttttgccgtttgcaagaagaaatttcccgagctggcccacgtgcccgagtttagcgaagatgcttttgacgagatgatgcgcgtgtcaaagcctgatatcgtcattgtggcaggcagggacgatacgcatgtcacatatattgtaaaaagtcttcagtggaatacagatgtgattactgaaaaaccaatggtgacaacagtgcaggatgcgaatcgggtgcttgaagcggaggccaaaagcgaaggaaaagtcaccgtcgcgtttaactatcgctacagcccgtttcatcggaaaataaaagaaatgattctggacggaaaaataggcagggtcacctccgttgatttaaattggtatattgatacgtatcatggcgccagctattttaaacgctggaacaggtcgagacagttttccggcggtctttctgtccataaatcaacacatcacttcgatctcgtcaattggtggctcgggcaaaatccggaagaggtatttgcttatggcgccttgaattactatgggccggacagtgagtggaaccccttgcccgaagaagacgggcgtttttgcgggacgtgccgtgttaaagaaaaatgccactactattcaaggtggcatccccgttcctctaaagcttctataaaagatgatcatctcgaagcaggagaccagtctagcttatatactgcatacaggcctgacgcgtgtatttttgacgaggaaattgacatcgaggatacgtacgtggcggcagtcaaatatgatggcggcgcactgttaagctactcgattattttttcggccccgtatgaaggctaccggctgacgatcaacggcacaaaagggcgtattgaatcaaatgaatttcacgaaccttccagaattccgtttgcttttcctgagcagacaatcgaatactatccgctttttgaatcaaagcagacgatacaagtggtcaaaaatgaaggggggcatggcggaggtgatccgcttttgcttgaggatctttttttaggaaaagacccgctgcgccgctatgatattttagccggggctgaagctggagcctactccatcgcggttggtgagggaatgtggcgctcggttgccgaaaagaagccgatcggcatgaaagagctttttcagatgcagaatgtataatgcaaaaaaggagggggcgccatggaacatgatggctcactgggacggatgctgcgtttttgcgaatggattatgagatttgcgtatacaaacttgctgtggctgttttttacgttactcggtctcggcgtgtttggcatcatgcccgcgaccgcggctttattcgctgtcatgcggaagtggatccaggggcaggacaacgttccggtgctcaaaacgttttggcaggaatataagggtgaattttttcgttcaaatctgctcggcgctgtactggcgctcatcggagtgatcatttatattgatttggccttcatctatccaagtcatttccttctgcacatcctgcgcttcgccattatgatatttggctttttgttcgtatccatgcttttttatgtgtttccgctgcttgtccattttgactggaaaaaacgtctgtatgtgaaattttcgctcttgctcagtgtggcgtatttgcaacatacgcttactatgcttgcgctgactgttgctctctttttcttgcttgcgtacctgcccggcattgtcccttttttcagcgtcagcctgatcagctactgccatatgcgaattgtttatgccgtgctgctgaaagtggagcagcaaggcggcgagccacagagggaatcccatatacggaaagctttttatccggaaacgagataatcatcatttctctatcataacgctgttccaaacggaatagattgatagagaaaggagagcggataaaatgctgaaggtagcggtatttgatgaagagcatgaaaaagacttacaaacggaaatcaattcatttttaaaagggatatcggaggagcagctgattgatatcaaatatacggtttcggcggcgtgcgacccagacggcgagcagctttactgtttttccgcccttattttatatcgcaaataaaaagatcttcccgcaggcgcggaaagatcttttttgttaatatgcttttttcactcttggacttctcggtttatcgagtttctccgcttttttgatctctcttctttcttttgagagcgattgatagagagaggcaatcatcagcaggataacgatagaaaacggcagcgctgccagaatcgctgtgttctgcaaagcggcaagccctccggaatataggagcacagccgccatggcggactgaatgataccccagctgagtttcacagaattcgccggatttaaagaaccgtacgacgtctgcatgcccagcacgaatgtagctgaatcagcagacgtaataaagaatactgcgatcagaatcaatgcaaggatcgatgtcaccattgtcagcggatagtgatcaagtgttccgaacagcatcgtttcagtggacagctttgctacattgaacgtgcctttttgctggagatccatggctgatacgccgaaaatggagaaccatagaaatgtcaaaatacaaggtgtcaccaagacgccaattaaaaattctcggatcgtccggcctctggatacacgggcgatgaaaatgccgacaaatggagaccaggaaatccaccatgcccaatagaaaatcgtccagctgttaatccattcgcgtttttcaggatcgttcggtgtcagtctgaagctcatttgaacgatattttgaatgtattgtccgatagaatctgtaaatgagttcatgatcagcactgtaggcccgacaacgagcataaacaacattaacaatccggccaataccatgtttgtgttgcttaaatacttaattccttttccgagtccgctccacgcagaaagtaaaaagagcactgtcacaataatgattaaaaccaattggacgataaacgcattcggaatgccgaacaggtaattcaaaccgccgttaatttgggttgcgccaagaccaagacttgttgacaccccgacaacagtggcgaaaactgcaatacagtcaatggcctttccgatcggtccgtttactttatccccgagaatcggtgacagtgtgctgctgattaacccgggtgcgcctttgcggaattggaaataggcaatgcataatgccacaatggcataaatggcccaagcgtgcaaaccccagtggaaaaacgtatagcggagtgcatctctgaaggcttggggggtttctgtttcacctgatggagagctaattgcgtaatggctgatcggttcagccgcaccgtagaatactaagccgattcccatgcctgcgctgaacagcatggcaaaccatgataataacccgaattccggtttttcatcaggctttccgagtttgatttttccgatcgggctgaaaatcaaaaagagacaaaacccgacaaacaaagagacaactaaaagataataccaaccaaatgaatcggtaataaatgcttgtgccgattgagacacattttgcaggctgtcaggagaaataacaccccataatacagctgcagctgtgattgcaatcacaatccaaaatacactagatatatgtttcaacatttctcaccctctaattttttgtgtacgcctatatcttgctcgcaggcttagtatggtcgtacgatggcagctcattcctctcttaaaattaccccgcaatcaggtgaaacaaaacaagtctcaccctaacatgaatgcggggaatgttcaaatgtgagtttggcggcaagagatttaaagagtaatgattaagaacgggcgtattgcccggcatttagccctgcaagcctgcctgtgacaagggcggaggtaatgttgtatccgcctgtgtagccgtggatatccagaatttcaccgcaaaaataaagcccctccatttttttagaagccatttttttcgggtcaatttcttttacagataccccgcctcccgtgacaaatgccttatcaagcgacagtgtgccatttgcgaggacagtaaactgcttgcagtcccttacaaattgtctgaaaggatccttcggcagctcagaaaacgatacgttcggagagatgccgtttttttcgagcaggaataggagatagcgctcctgcatccaaggcttcagcacgtttttaatggtttttttcggtgcttccttcagttctttatacatcttttggaaaagcgtttcttcattgatatccggatacaagtcgattctgatcggcacttgaggctgttttttcagctcttttacgacaaattggctgcatctgagaatggcaggtcctgagaggccgaaatgggtaaacagcatgtccattttatgtgtgataatcggtttgccttttttatttaacacactgacggctacatctcttagtgataagccctggagtgttttttgcttaatgaacggttcgccagaagtgacgggaacctctgtcggaaacagctctgttatggtatgacccgcggcttcagcccattcatagccgtctcccgtgcttccggtatgaggcacgcttttaccgccgacagcgataatgactgcctggctatggatcatttcgccattattcgtcacaatccctgctgcctgtccatcttcatataaaacagatttaattttctcgttcgttctgattgttacgcggagctgcttcagcctgtttaacagcgcgtcaacgacactttgggctttgtcggtcacaggaaacatccggccgtgatcctcttccttcaattgaatgccgaggttttcaaaaaacttgataatgtcctcattattaaattcagaaaacgcgctgtataaaaaacgcccgttgccggggatgtgcttgataatttcttccacaggaaggcggttcgtcacattacagcggccgcccccggaaatcgcgagtttccgtcctaatttatttcctttatctatcagcaacacgccagcgccctgttctcctgctgcaatcgcagccatcaagcctgaagggcctccgccgattacgattacgtcatattgtttcatctttatcatcaactttcttttcatttcgtgtgcggacaccccgtccgcagtactattatagcgaaagaaagccgctccttaaacgtcttttgccgcggacatgaatgttcacaggattgcttttgtatttattaccgtctaaatgcccagttgtggtaaaatagaaaagttgaatcttcgtagaaaatggtgatgaagaaacatgtcaagcaaactgttaagaggcacgtttgtattaacgctcggtacatatatatcgcggattctggggatggtctatttaattcccttcagcattatggtcggggcgacaggcggtgcattatttcaatacggatacaaccaatacactttatttttgaatattgctacgatgggctttccggccgctgtttctaaatttgtttccaaatataattcaaaaggggattatgagacaagcaggaaaatgctcaaggcgggcatgtcggttatgctcgtcacaggaatgatagcctttttcattctgtatctatcggctccgatgtttgcggaaatatcgctgggaggcaaggataataacggcttgacaattgatcatgtcgtttatgtcatccgcatggtcagcttagcgcttttggtcgtaccgattatgagccttgtccgcggattctttcaagggcaccaaatgatgggtccgacagctgtttcccaagtcgttgaacagattgtccgcatcatctttctattgagtgcgacattcttgattttgaaggttttcaacggcggccttgtcatcgctgtgggctatgcaaccttcgcagcgctgatcggtgccttcggggggctggtcgtgctttatatttattggaacaaacggaagggcagcctgctggcgatgatgccgaatacgggtccgacagcaaacctaagctacaagaaaatgtttttcgagctgttcagctatgctgctccgtacgtttttgttggactagccatccctttgtataactatattgatacaaatacgtttaacaaagcgatgattgaagccggtcatcaagccatcagccaagacatgcttgcgattctaaccctgtatgttcagaagctcgtgatgatcccggtttccctagcaactgctttcggactgacattaattccaacgattactgaatcgtttacaagcggaaactataagctgttaaatcagcagattaatcaaacgatgcagacgatcctgtttttaattattccggctgttgttgggatctctctattgtcaggaccgacgtatacgttcttttacgggtcagagagccttcaccctgaactgggggcaaacattttgctatggtattcgccagtcgcaattctgttctctttgtttacagtcaacgcagccattctgcagggcatcaataagcaaaaatttgcggttgtcagccttgtgatcggcgtcgtgatcaagcttgtgctgaatgttccgctgatcaagctgatgcaggctgacggagcgattttagcgacagcgcttggatatatcgcttcccttttatatgggtttatcatgattaagcgccatgcaggctattcgtataagatactagttaaacgaactgttttgatgctggtcttatcagccattatgggtattgccgtgaaaatcgtgcagtgggtattaggcttctttatttcctatcaggatggccagctgcaagctgcgattgttgtggtgatcgcggccgctgttggcggagctgtctacctgtattgcggctaccgattaggatttttgcagaaaattttaggccgccgtttgccaggtttcttaaggaaaggcagacatgcaggctgatgaactagatatgatgaaactgagggctcgcatgctgcgggctttcttttataaaggagagattgggaatgagacttgataagctgcttgccaacagcgggtatggttccagaaaagaagtcaaagccgttgtgaaggctggagccgtgatgatcgacggcaaacctgccaaagatgtaaaggcgcacgttgatcctgatacgcaggaggtgactgtatacggggaaccggttgattatcgagagttcatttatcttatgatgaataaaccgcagggcgtgctgtcggcgactgaggacagccggcagcaaacagtggtcgatctgctgacgccggaggagatgagatttgagccatttccagccggcaggcttgataaagatacagagggctttttgctgctcacaaatgacgggcagctcgcacatcggctcctttctcctaaaaagcatgttccaaaaacgtatgaagtccatttaaaatcacagatttctcgggaagacatctccgatttggaaacgggtgtctacatagagggcggctataaaacaaagccggcaaaagcggaaatcaaaacaaacgacagtggcaataccgtgatatacctgacaattacagaaggaaaataccatcaggtcaagcaaatggcaaaggcagtcggcaatgaagtggtttatctgaagcggctttcgatgggacgcgtttccctagatcccgctctggcacccggagaataccgtgagctgacagaggaagagcttcatttgctcaatgagccgcaagcatgacaaaaaccccgcataccgaatgcggggtttttatttataagcacacaaaaacaaggctcagtagtttcttcgccctattatctatcgggccgctctcaggcggccctatgtaatttttcaatttatgaggtaatctttactttctttctcgttgtctcccacttgccacggcttggactatgaacaagatcattatatgccaacacatttaagtctctttgaatcgttctaggtgtaatgccgaattcgtcaaccagttcctgtgttgtcacaagacctttttcttggataaacatgtaaactgatttgattcgagttagcatacggtttgttgaaggtttcaaaaaaccactccctatcataagatcggatggacttgactaaccacaactcacgactatcaactgcgtacgaaatagcaacaaaggcagacatctgtaattgttaaaataattcgccctcattatacacgatattgcagtgatgaatctagggataactcctattaattttttccaattcgcgttgggcagccatccttgttggattactatgtatttcggctcaatattattatggttaaagaaactttttttattctgtttcgtagtaaattttggaggtgggtgagttttgacaaatttgcttgaagcttcaatagaacaggccgggtatacaagccgaaaaaaagtgctcaccgatttttttctggaagtcagaaaaggggaactagttggactgatcggagctaacggcgccggaaaaagcaccgcaatcaaggcgatactcggcctttcagaagattttaaagggcatattgcctggaacgactgttcatttgcatatattccggagcatccgtccttctacgaagaactgacgctgtgggagcatttggatctgatcagcacactccacggcattgaagagagggaatttgcgcatcgggcccaaagcctgctgcagacgttttcgcttgatcaggttaaacatgagctgcctgtcaccttttcgaagggcatgcagcaaaaactaatgcttatccaggcctttctctctaagccggatatgtatgtgattgatgaaccgtttatcggccttgatccgatatcgacgaaacgctttgtggacatgcttaaggctgaaaaagaacgtggagccggaattctgatgtgcacgcatgtactcgataccgcggaaaaaatctgtgaccggttttatatgattgagaaaggttcattatttctccaaggcacgttaaaagatattcaggacaagaccggattagaggggcagtcattgcttgactgtttttataaggcagttcaaggtgatcggctatgaacgggcgtacgctcttttttcgaaggctgtttgactattataagtatcagtttaaagtgttgcatgcggtcattgactggacagtcgctctctatatcgttttgccgacgattgcttttgtcatctatcagtatattgatttgatgaacggaagaggccttctttatgagtggtctgaagtggcggagtggagatggctgtacgctgtgtgtgggctgatcatgtttacaggctcgattcgtacatttttaatggaagcggacaaagtgtttttgctgcaaaagaaggaaatcatctatcagctcaaacggtacgcgcttttgtattcttttctggtcacgctggctaaatggctgcttctcttttttattgtccttccccttatcagtcattttgttcacatcacattcgcagaaagcactgctctattgtgttatttgtttggccttcatatattctttttatccttaaagcaagacaggatcagaaagccgcgctctatttcgagatggattggcgatatccttgtcagagctattctttttactggttctgctatcctgattgttttgactcagtggcacttgcttgcgctttttggcattttatttttgcttttctcagttatccgcagtttgaaaaagacggcttcgttcacggcttttgaagctgaggtgactgaagagaaaaaaagcaggcttgctcttgcaggacttgtgatgatgatgagtcaggaggcgggaatgccaaaagtaaaagacaggatgagaagaaaaccgttattataccgtaattcaaaaaggatatttaaaagacgaacgatctgcacaggctataaggaattgttttttaaagtcatgctgaggaatggcgagtatgcgaggcagatgtacatgctattgtcagctttcaccgttctcatatttgtttccccaatttggctgaaggtgattgcgctgctggtatatacaggggtttgccgttatatcctgacgcttatttttgacaaggtcatggatgccccttttttaattggcgccgataaggaaagtgatgaatattatcgggccagaaaaagctgtatcaatatcctgcactatgcgtttgccgcctgttgttttttagcggccgctgtctctttattgtttacataaaaaacccaaacggcgacgtttgggtttttctgtatgcattataaaataaacagctggatgaaaaacagaatggcgaaaacgatgacgagcggatgaatctctctccattttccccgcgccgcttttactattgggtacgaaataaaaccaagcgcaattcctgtagaaatgctggatgtcaaaggcatggccagaatgacgagaaacgctggaaatgcctcgtccatctctttccagttcatattggaaactgaacccatcatcaagctgccgacgataatcaaagcaggcgaggtgatggcggctataccggacaaggcgctgacaagcggactgaaaaacattgaagccgcaaacatcacagccacagtcaaagccgtaagccccgttcttcccccggctgcgacaccggcggaagactcgataaatgcagtcgtcggacttgtgccgaaaacagctcctactgtcgtcgcggttgaatcagcaagcagcgcttttcgcacgttcggcagcttgttgtttttcatcagcccggcttgctcggcaactccgatcatcgtgcctgtcgtatcaaatattgtgactaatagaaaagaaaagacgacagcgtacaggccgtgatgaatgacatcgccaaaagcggtaaatggatttgagatcatcaatccttccggcaaatgaggaagcgacataaatccctttggaaaatggagctgaccggtgaaaaaggcgattaaagcggtagctgccattccgataaataaagcgccgcttacattcagcaccatcaggaccacgctgatcaaaaggccgaccagcgttaagataacaccaggtgaatgcagattgccgagagtgaccaggtttgactcatcagctgccacaattcccgcttgacgcaaaccgataaaagcaataaacagcccgatccctgttgtgatcccgtattttaaattgtttggaatcgcttctataagttgttttcttaaaggcgttaacgatagaataatgaagagaacccctgctgtaaatactgcgctgaaagctgttgtgtacgtgatgccgccatcgcttgcgcttacgacatgaaaggctaaataagcgttcaagcccatgccgggcgcaatagcaatcggataatttgctgccagggccatccacagcgttccgacaatggaggcaataatcgttgcggtgaaaacctggtcgaaaggaaccccggcgttagccagaatgaccggattgaccacgacgatatagaccattgtgaaaaaggtcgtcagccctgctatgatttcttgctttatggatgtttgctgctcttttagatgaaacatagtatcctccaattacgaacgttttaacaaaacaccattaatattattcgttttatttggtttttgcaagtcatttcttgcggaaaggggatcattatgaactgggaagttgaagtgatcagaaaaaaagaggatttaattcgtgatacgcaggaatttttgagaatcaacagtgtcatggacgaaacaaccgccggacccggtaaaccgtttggagaaggggtaaatgccagcctgacttcattgctggagcttggagaaaaagaaggctttacaacaaaaaatcttgacggcttcgcaggtcatattgaatggggggagggcgatgacattatcggcgtactttgccatgttgacgtcgtgccgccgggagatgggtggacgagtgatccattttcagctgaaatccgcaacggacggatttatgcaaggggcgccattgatgacaaaggcccgacaatggcggcattctacgcgctgaaaatcgtgaaagacatgaatttgcccctgtccaagcgagtcagaatgattatcggaacagatgaagaaagcgattggagatgcgtagagcattatttcaagcatgaagaaatgccaacaatgggctttgcgcctgacgccgattttccgatcattaatgcggaaaaagggatcatcgatgcttctttacttattccgcaccgcctaaatcaagctgaaccaaaggcagtgcttgtctcgtttcaatcaggccttcgcttaaacatggtgcccgacgctgcggaagctgtcattgaagggccgaaaaatgaagagattctgtcttcatttaaagacatgctccgcacgacggatcaaaaaggggaagctgcaatagagaacggacagctcattttgcgtatgtacggtctttcctgccatgcgatggaaccgaacaatgggatcaatgccggcattttattgtgcgaatttctccagcagactgagcttgacgatgcaggaaagcggtttgtgcaagttgtgacagataagttctcaggtgatacaagaggaaaaaaactggacatcgactgtgaggatgaaatcagcggtgagctgacattaaatgtcggaacactgcgctataaagaagggcaaggaggcgagctcgggatcaatatccgctatcctgtgacagcagaaagcaaagcgattcgcgatgcattcgaaagtgcatctgaatttgatctgggagaattcaaagacagcaagccgcatcacgtgtccgcagatcatccgttagtcaaaaccctgcaaaaggtttatgaaggccagctgggtaaaaaagctgacttaatctcaatcggcggggggacatatgcgagatccttaaaagccggtgtcgcgttcggcccgctgttccccggacgccctgacagcgcacaccaaaaggatgaatatatcgaaattgatgacctgctgagatcgacagcgttatatgctcaggccatttacgagcttgcaaaataaaaggaccggcttctgctgaagccagtcctttttttaaataaatgaccataaatcagttgataagtaccgttctcctgtatcagctgtcatgcagaccacaactttgtcaggagagaggcgtttcgctgtttcgattgccgcgaagcaggcagcgcctgatgaaggaccgacaagaattccttcttcagcagcaagccgtcttgtcgtcgtatacgcgtcttcatcagagattttgataatttcatcataaacgtcttcatttaaaatcggcggtataaagcctgggctcgttcctacaagtttatgcgcgccaggttttccgccggataatacaggcgaacccgctggctcaacaacatgaaccgtgatatccggaaaaagctctttgagcgcctcacctgttccggtaatggttccgcccgttccagaggaggcgacaaaagcgccgagcggttttccgatttcctctattgcccgggcgatttcaggcgctgttgttttccggtgcgcatcaggattagcagtgttatcgaactgcattggaatatagctgttcggaatttgttcggcaagctccttcgcttttttgatgctgcccggcattctttcctctccgggagttaatacaacctctgcaccgtaagctttaagcaggttgatccgttccttcgtcatcgtatcaggcataactaagattgctttatatccgcgtgctgccgcattcatggcgagcccgattccggtatttccgcttgtcggctctataataactgatcccggcttgagtaaaccgttttgttcagcttctatgatcatttgataagcggctctgtctttcacactgccgctcggattgaaaaattcaagcttcaaatagacttgtgccgcattttccggctgaagcctattcaatctcactagcggtgtatctcctatcagatcagctgtgtttgcaacgattttcaacattgtcattcctttctgaataaaacaagtgtcatataatatcctaacataataaacgtttgtgcgagagtgttttcatacactgttcctctatccgcacagcctctttattgataaaataatagctgtcaaagaagggagtgtcagacggatgccagatatacggcctcattatttcatcggcgttcccatacctgagggaattgcaaatccgatctaccaggctgcgaaaaacgaaccggtattgacgtttcaaaaatgggtgcacccgcttgactatcatatcacgttaatttttctcggagcggcggatgagacacaaataaagaagcttgaaggttcgctagcagagattgcttcagaaattgatccattttcaattaagtttggcaagatagatgtattcggcgaccgcagaaagccgcgcgttttacatctggagccaaagaaaaacaaaacgcttgatagactgcgggaacatacgaagcaggctgtacttcaggccggctttcaagtggaaaaaagaccgtatcatcctcatatgacgctggcaagaaaatggacaggcgaagatggatttccagctcatgttccgtttgaaagcggcgaggtttcgatgatggctgaacgattttcgctctttcaaatacacttgaaccaatcaccaaaatacgaggaaatattcaaatttcaattatcttaattcattgcggagtggagaaacaaacatggcacaaatcatcaaaattcatgattatatatcgagatatgagcttgatccgtaccattatatcaaccagtttgtacgtttgaaaaaagagcgctggctttcactagtagaagcagcggagcgccagcatgaagaaaggcaagccattgctgaagaaccggaaccggtgcagaaacgaaaaaaattttcattgaaaagaagaaaagaagagataaaagccgatatacaagaagagagacaccaatggtttgaggacgaagaagatattcatgtaaggctcccgaagagcagggtggcgcttgcttctttttataaaaggcatttatatgattttcagctcaaatgggcaagctctactctttcagaaatatctcaactctcaaaccaggtgaagcaggaccgcattttgcgttatctgacccagcagctgcctgattcttattttattatgtataagcctgtgctgaaaattcagcaggcggcggttgaattaagcattgtgattatttctcctctggaaatttattgcgtttcttttttagaggctgaggaagacagtgtctacatagggtctaaaaatcgtttttgggacaagaaaacagcctctcagactgcatcagtgttaaatccagggcttagcctgtttcgcacggactcggttgtgtcgaagatcgtaaaggaaaaacaggctgagatcccggttcgaaaattgcttctgagcagaacgtcgtacatcgattacccggagccgccatacggcttagaaatagcggataggcggagcgcggaagaatggattgagcggcagaagaaaaacactgcgccgatcaaacatcatcagataaaggctgcaaaggctctattgtcttactgcatgtctgactcctatcgcagacaggagtggctggagtaaaagagaacgatttgagcggttttctcataacataagcaggtgagaaagatgagccattggttttttattattaatccgacagcaggacatcgaaacggcctgcgtgtttggaagtccattcaaaaagaattgatcaaacgaaaggttgagcaccgttcatttttaactgaacatccgggacacgccgaggtgctcgccagacagatttcaacgatacaggaatataagctgaagcgcctgatcgtcattggcggagacggaaccatgcatgaagttgtcaacgggctgaaagatgttgacgatattgagctgagctttgtgccggcgggcgcgtataatgatttttcgcgaggattctctattaaaaaaatcgatctgatacaggaaatcaagaaggtaaagcgcccgttaacaagaacctttcatttagggagcgtcaatttccttcaggataaatcacagattctttattttatgaatcatatcgggatcgggtttgacgcatatgtcaataaaaaggcgatggaatttccgttgagacggttttttctttttctccgccttcgatttcttgtgtatccgctttctcatttgcacgcttcggcaacctttaagccgtttacgttagcttgtacgacggaagacgagacgcgcgaatttcatgatgtctggtttgccgttgtatccaaccatccgttttacgggggaggcatgaaggcggcgcccctagcaaatccgcgcgagaagacatttgatatcgtaatcgttgaaaaccagccgtttttgaaaaaatattggcttttatgtctcatggcatttggaaaacatacaaagatggatggcgttacgatgtttaaagcgaaggacattacattttacacgaaggacaaaatcccgttccatgctgacggagaaatcatgggcactaccccgtttcgtctggcatctagtccttcacccctaaggatcaaaacataaacgtgtttgaaggagagagcttccgatggtcagcatccgccgcagcttcgaagcgtatgtcgatgacatgaatatcattactgttctgattcctgctgaacaaaaggaaatcatggcaccgccgtttcggcttgagacagaaacaacagtttttcctctggctgtcagggaggaatactcccttgaagcaaaatacaagtacgtctgcgtatccgaccatcctgtgacatttggaaaaatccattgcgtcagagcatccagcggccacaaaacggatctccaaattggcgcggtcatccggacggctgtgttcgatgacgaattttattatgacggagagctgggcgccgtttataccgcggatcataccgtatttaaagtatgggcgcctgctgcaacctcagctgctgtcaagctttcacaccccaataaaagcgggcgcacattccaaatgactcggttggaaaaaggcgtctatgccgttacggtcacaggtgaccttcacggatatgagtatttgttttgcatctgcaacaattcagaatggatggaaaccgttgacccgtatgccaaggctgtgactgtaaatggagagaagggcgtcgtcttgcgcccggatcaaatgaaatggactgctcctcttaaaccattctcacaccctgtggatgccgtcatctatgagacgcaccttcgcgacttctccatccatgaaaacagcggcatgataaacaagggaaaatacttagcattaacggaaactgatacacaaaccgcaaatggcagttcttctggactggcgtatataaaagagctcggtgttacacatgtggagcttctgccggtgaatgattttgccggagttgatgaagagaagccgcttgatgcatacaattggggatataacccgcttcatttctttgccccggagggaagctatgcctcaaaccctcatgatcctcaaacgagaaaaacagagctgaaacaaatgatcaataccctgcatcagcacggtctgcgagtcattctggatgttgtttttaaccatgtgtataagagggagaattccccctttgaaaagacagtgccaggttattttttccggcacgacgaatgtgggatgccatcaaacggcaccggcgttggcaatgatatcgcatcagaaagaaggatggcaagaaaattcattgcggattgcgtggtctattggcttgaagaatacaatgttgacggcttccgctttgatctcctcgggattttagatattgacaccgtgctttatatgaaagagaaagcaactaaggcaaagcccggaatcctgctttttggagaagggtgggatctggctacaccgctgccgcatgaacagaaagctgctttggcgaacgcgccaagaatgccgggcatcggcttttttaatgatatgtttcgtgacgctgtaaaagggaacacctttcaccttaaggcagcagggtttgcgctcggcagcggtgaatcagcacaagctgtgatgcatggaattgccgggtcttccggatggaaggcattagcaccgattgttccggaaccaagccagtccatcaattatgtcgaatcacacgacaatcacaccttttgggataaaatgagctttgcgcttcctcaagaaaatgacagccgaaagcgaagcaggcaaaggcttgcagccgcgattattttgcttgcccaaggggtgccgtttattcacagcggccaggaatttttccggacgaagcagggagtggaaaacagctatcaatccagtgacagcatcaaccagctcgactgggatcgccgtgaaacattcaaagaagatgttcactatatccgcaggctgatctcgctgagaaaagcgcatcctgcattccgtcttaggtccgctgcagacatccagcgccatcttgaatgcttgacgctaaaagaacaccttatcgcatacaggctttatgatcttgacgaggttgacgaatggaaagatatcattgttatccatcacgcgagtccagactccgtcgagtggaggctgccaaacgacataccttatcggcttttatgtgatccatcaggatttcaggaagacccaacagaaatcaagaaaacggttgcagtaaacggcatcggaacggttatcttatatttagcatcagatcttaagagttttgcttgacgaagtttgtgctatagcgctaaaatttaaaggacggctattgattagcatatgagactctcaatagctgtcttttttatttttatacgattcgtacgaaaaaggcattcgctggatagactagagacgattagccttaattctaaaatattttaagaaatgatgggttgaacattgatatgaactggttgggacaattactaggtagcgattgggagatcttccccgccggaggagctacaggagatgcatattatgcgaaacataacgggcagcagctttttttaaaacgtaatagctcaccttttttagctgttttatccgccgaaggcattgttccgaagctggtttggacaaaacggatggaaaatggggacgtcattacggcccagcactggatgaccggcagagagctgaagcctaaagacatgagcggacggcccgttgctgaattgcttcgtaaaatacacacatcaaaagccttgctggacatgctgaagagacttggaaaagaaccgctgaacccgggggctcttttgtctcagctgaagcaggctgtatttgctgtgcagcaatcttcgccgctgattcaagaagggatcaagtatttggaagaacacctgcatgaagtgcatttcggtgagaaagtcgtttgccattgtgatgtcaatcataataactggctattgtctgaagacaaccagctgtatttaattgactgggacggcgccatgatcgctgatccggcgatggacctcgggcctttgctgtaccactacgtcgaaaagccagcttgggagagctggctgagcatgtacggcatagagctgacagaaagccttcggttgcgaatggcttggtatgtgttatctgaaacaattactttcattgcctggcataaagcaaaaggcaatgataaggaatttcatgatgcaatggaagagctgcatatcctcatgaaacgaattgttgattaatcaggaatacgaatccatttgctctacccattgagacaggctgttctgatgctcttgtatgtgtgagtcgatggatttggacgatattcctgattggctgtagcggtaaacatcttcaagcacgtttttgaaatttgaatcaagctcggtgtttgccatcagtgatttaatcacacgctcaagctgctcgtactctgcgactgttccgcagcagtccaattgatggtcagtcaatatatccttcaataaatgaacttgatgctcataatgtaaacccataacggtacacatcccttcagtatcatacgggttaaattgttcaaaacagagcgtttttatacatgtgaaaggagtgttccagcagacgggaccctctttttttatgcgctcggtcttaagagagatacactggaaaaacgagcttgcgggtctttttaattcatggtatgttgttagtcgaaataatagatagaggtgtcaatcatatgagaatgcgccacaagccgtgggctgatgactttttggctgaaaacgcagatattgccatcagcaatcctgctgattataaagggaaatggaacacagtgtttggcaacgacaatccgatccatatcgaggttggtacaggaaaaggccaatttatttctggtatggccaaacaaaattccgacatcaattatattggtattgagttatttaaaagcgtcatcgtgacagccgtccaaaaagtaaaagacagcgaagcgcagaatgtaaagcttctgaatatagatgcggacacgctgacggatgtgtttgagccgggggaagtgaaacgggtctacttgaacttttctgatccttggccgaagaaacggcatgaaaaacgccgcctgacatattcccacttcctcaaaaaatatgaagaagtaatgggcaaaggcggatcgattcattttaaaacggacaaccgaggtttgtttgagtactccttgaagagcttctctgagtacggcctcctgctgacatacgtcagcctcgatttgcataacagcaatctcgaaggcaatattatgacagaatatgaagaaaaattctctgcactcggccagccgatctatcgggctgaggttgaatggagaacgtaaagacagactctgacaggagtctgttttttttatgggctgtttgctaccatgatgacaggggggatgaaaatggaaacaatgaagattggaaacatcacgttgacctggcttgacggaggcgtgacgcatatggacggaggcgccatgttcggcgtcgttccaaagccgctatggtctaaaaaatatccagtcaatgaaaaaaaccagattgaactaaggacagaccctattttgattcaaaaggatgggctcaatatcatcgttgacgccggaattgggtccggcaagctgactgataaacaaaaacgaaactatggcgtgacacaagagtcgaatgtgaaaccctcattagctgcactcggattaacggttgccgatatagatgtgatcgcaatgacacaccttcattttgatcatgcatgcggtttaacggagtatgaaggtgaacggctcgtctctgtctttccgaatgcagtgatttatacatctgctgttgaatgggacgaaatgcgccatccgaatatcaggtcgaaaaatacgtattggaaagaaaattgggaggctgtagctggccaagtcaaaacctttgaagacaccttaacgatcacagagggtattacaatgcatcacaccggaggccatagcgacggacacagtgtcctgctatgcgaggatgcgggtgaaactgccgtacatatggcagatctgatgccgacacatgcccaccgcaatccgctatgggtgctggcttacgatgattatccgatgacctctatcccgcaaaagcagaaatggcaggcgttcgcagcagaaaaagacgcttggtttattttttatcatgatgccgagtatcgcgcccttcaatgggaggaggacggaagcatcaaaaagtcagttaagcgaatgaagcaatagcatatttttatgtttaccctgcatgttttccggctaataatgcaaacctagtactaattatgctcagaaaggaagaggcagggtgaaacaattcagagtaacaaacgaaggagacattcaaacaacattaagaggccttgaagtgctctctgttccttttttgaacaaaggtgttgcttttactgaggaagaaagaaaagaacttggtttaaaaggctttctgccgcccaaggtattaacaattgatgatcaggcgaaaagagcgtatgaacaatattccgcacagcctgacgatttgagcaaaaatgtctatttaacggcgctgcacgatcggaatgaaacgctgttttaccgcctgttaaatgaccatttaggggaaatgctcccgattgtctacacaccgacagtcggaacggcaatccagagatacagccatgaatacagaaaaccacgagggctctatctgtcaatcgatgacccggacggtatgaaagaagcatttaaacagtataaagatcaaagcgatacgatcgatttaattgttgcaactgatgcggaaggaattttaggaatcggtgactggggcgtcggaggaatcgcgatttctattggcaagctggcggtttatacagcggctgcgggcattgatccgagcagagtgctggcagttgttttagatgcggggacaaatcaggagagcctcttgaacgacccgctttatgtcggcaaccagcattccagagtgcgcggcgaacgctatgaccaatttattgacgactacgttgcgctggcgagagaaacatttccgaatgcattgctgcattgggaggatttcggggcgaaaaacgcgcgaagcattttgaaacgctataaagataaagtgtgtaccttcaatgatgatatccaaggaactggcgctgtttctttggccgcagtcttatcctgtgcaaaagcgtctaaagttccgttgagagatcacagagttgttatattcggagcgggtacggcaggaatcggaattgccgaacagctgcgggaagcattggtgcgcgagggactgagtgaagaagaatcatacaagcgcttctggtgcatagacagaaacgggctgttaacagatgatatggatcagctgcttgatttccaaaagccgtatgctcgttcggctgatgaagtgaaggattatcagcggaacggagacggcggaggcattgatcttcttgaagtggtccggcaggcgaaaccgacgatcctgatcggcacatctacagtttccggcgctttcactgaagaaattgtaaaagaaatggcgtcacatgtgaaacggccggcgattttgccaatgtcaaatccgacaactctttctgaagcaaaaccggaggatttaatcgaatggacagaaggccgtgcgctgatcacgacaggaagcccgtttccgccagttgaatataacggagttacgtatcatatcgggcaggcaaacaacgcgcttgtcttccctggtctcggtcttggaacaattgttaccaaatcaaaattaattaccgacggcatgtttgaagcatgtgcccgggcaatcgcaggtatggtcaatgtcggggtgcctggcgcgccgatgcttccaaaagttgaagatttgcgcactgtttcggcaaccgttgctgttgaagttgcaaaaactgcaataaaggaaggcgtcgctacggaagagcctgaagacattatacaggcagtgcaggatgcgatgtggtatccggtatacaaaccgattcgcgcgatataataaaaaagagccgctgcataggcagcggcttctattttttgcttgtccggtgttaagaggcgattgtatcaatgacatcaacaatttctcccgttttcgcatccaccatgacttcatactgttctaattctccgaaagctgatcgtgtaatgccggttttgtatacctgtaccgtttctccgttaatattgtaaggctccggctgggtgtaaatccatgatccgtcaatcgggccccgctgcttaaaagcagactttacaatgcgaagcgctttttctgaagaaatataaggcttcatcacatattgtttcacaacgacagccgtacaaattccaagtcctgctcctaaaagaagatgacgcaatttcaaaataaagcacctcctggttgatcgtacttttcattatacagaaacagccaaatcctgttaagcaatacgcggctgatcgagcagattgggtcagggtgcttggaaaacttcattgtttctaataaaataaaaggactacatagaaatgaggggaaaacatgaatcaagaaacgaaagcgcttttccaaacactgacgcagcttcccggcgcgccgggcaatgagcatcaggttcgtgcttttatgaagcaggagctagccaaatatgccgatgacatcgttcaggacagactgggaagtgttttcggagtcagacgaggcgcagaggacgcaccgagaattatggtagccgggcacatggacgaagtcggcttcatggtgacatccattacagacaacgggctgctcagattccagacgctcggaggctggtggagccaagttttgcttgcgcagcgggttgaaattcaaacagataacgggccggttccgggtgtgatttcaagcataccgccgcatttattgacagatgcgcagcgaaaccgaccgatggatatcaaaaacatgatgatcgacattggagcggatgataaggaagacgccatcaaaatcggcattagaccgggacagcagatcgtgcctgtttgtccgtttacgacgatggcgaatgaaaagaaaattctatcaaaagcatgggataacagatatggatgcggcttaagcattgaacttctgaaggaattacacggtaaagagcttccgaatacactctatgcgggtgcaacggttcaggaagaagtagggctaaggggcgcgcagacggcttctcatatgattaaaccggacttgtttttcgcccttgacgccagcccggcaaacgatatgagcggagacaaaaatgaattcggccagcttggaaaaggctttttgctgcgcattcttgacagaacgacagtcatgcatcgcggaatgagggaattcgttcttgatatggctgaaacgcatgatattccatatcaatattttgtatccggcgggggaacagacgcaggcaaggttcatatttcgaacagcggtgtgccgtcagcggttatcggaatatgttcccgctatattcatacaaacgcttctatcattcatattgatgattatgctgctgctaaagaaatgctcatcaaacttgtaacagcctgcgataagcagacggtggatgcgattaaagaaaatatgtaggtttcataaaagcttgttgaacgagcagtaagcccggatcgacaagcttttttcttattctgtttcaaatagataggaaagggccttaatggcttggttaacggtttcaaccgtaatattcgctttattggaaagctcttttaaaggatggtggagcgattccggccggatgataatcaggggttttccttttgcgatcgcatatgatgcatccattgccgtgttccactgtttgtacttttcgccaaacagggcgatcacaaagtctgctttattcatcaggacggcggttctgaagttgttgatgtcagaggctttgtcatcctttaaaacggcatttggctgtacgcccataatttcttcaccaatattgtctgagcggtcatgattctccatcgggccaacaaacgtaatcgggagcttcagtgattttgttttctctttaatttcctcgcgccaattgctgtggatttctcctgctaaatagacgataaactccatataaaaatccctccttatgtatgtccatctgtaaattttaccctcatgtacacgatgttaaacgaaacgagcttgataatgcaaataaaatatgataatgataatgggaaagccaatcttacatattcattcgttgcatataagtggttttgcctcaagcagtttggtatgatccaaatggacgagtatcgataaaaaacatgtaagaacataaacaactggagggatatgaaatgaaaaaaattgaatcaactcaagagctggaaaaagcggtaaaggatgattggtctgtatttatgttttcagccgattggtgcccggattgccgttttgtagagcctttcctgcctgaattggaagcgaatttccctgaattcacctactactacgtagaccgtgacaaattcattgatacatgtgcagagtgggaaatttacggaatcccaagctttgtggtgtttaatgaaggaaaagaagtaaatcgttttgtgagcaaagaccgcaaaacaaaagaagaaattgaacagtttttaacagactctctcgctaaagcgtaaaggaggacatcggtttgaaaatgacctcaaggaagctgtcagatatactgaagcagcgccttcagcacgagaatcgctcctttctgtttgacagagaaaaagacaccctccgtgttgaggatcaaacgactaaaaaagggattacactcgatttgccgccgattattgcaaaatgggaactgaaaaaagacgaagccattgatgagatcgtgtactatgtctccgaagcgatgacggcaatggaagggaaggctcaggaaatgaccgggaaagaaactcgcatttatccggtcatccgctcgacttccttcccggacaagtccagtgaagatatcccgctcatttatgacgatcataccgcagagacaagaatttattacgcgcttgatctcgggaaaacctaccgtttaattgaccagcgcatgcttgagaaagaaaactggacaaaagagcggatcagagagacggccgcatttaatctccgttccctgccgacggttgtcaaagaggatacggttgccggcaattacttttatttcttcagggcaaacgacggatacgacgcaagccggattttgaacgaagcgatcttaaatgaatataagcagcatgcagaaggggagctggcgatctctgttcctcatcaggacgttttgattcttgctgacatccggaatgaatcggggtatgatattctaggacaaatgtcgatgagcttctttgcaggcggcaccgtcccgattaccgccctatcatttttgtacaatgaaggaaagctggaaccggtgtttatcctggcgaaaagccgtccgaaaaaggattagaaaggatttttacttatgaacgctttttataataaagaaggtgtgggagacacgctcctgatctctcttcaagatgtgacacgcgaacaattaggctatgaaaaacacggcgatgtcgtcaaaattttcaataacgaaacaaaagaaacaacgggcttcaacattttcaatgcgtcttcttacttgaccattgatgaaaacggccctgttgcgctctcagaaacattcgtgcaagatgtgaatgagattttaaacagaaacggcgttgaagaaacattagtcgttgatttatctccgaagtttgttgtgggttatgtagaatcaaaagaaaaacatccgaatgcggataaattaagcgtatgtaaagtcaacgtaggagaagaaacgcttcagatcgtctgcggcgcgcctaacgttgacaaaggccaaaaagttgtcgttgccaaagtcggtgctgtgatgcctagcggacttgtcattaaggatgcagagcttcgcggcgttccgtcaagcgggatgatctgctcagcgaaagagcttgatttgccggatgcccctgctgaaaaaggaatccttgtgttagaaggagactatgaggcgggagacgcatttcagttttagactcccataaatccgccaaaaaaaacgaatcatgtgaaaagccgctaagcccttgtttagcggctttgtttctgctgatagcttaatcttttctgggccgaccagcagtggtatactaaaaaccgtcccagaaaactataagggagttagagataaattatgagttggcttcataaattttttgatttgtttttaggcgaaagcgaagaggatgctgaacgggagacaaaacccgctcaaattccgcagcaacaagaagtacatcatcctgaaggacaattaaaaagattggaagatcctaaaatatattatgaatatccaaaaggcaaattccgttttccagtcgtgcctgacggatacaaaaatcatgacctgagaaggcgccgcacaccatcggacgaaccgaaatccgcgcctcgcccaagtgctgcaccttacagagagcgtcccagaaatgaaaaagagcagcatacatatcaagcagcagagccggcgaagaaaccgtttaaaccgacaaatatcccttcgcctgtctatggattcaatcaaaaaccatctgttaaaaaggatgtgccgaaaaagccttctgaaacattgaacgaaccggataaatcggtaaaagagaaggtaacactgctgtcagaagagatcgaacgtgaacgcggctatcctgcttcagacacacaggcgcattccaaaaaagaaagtcctttcttcccggatacccaatttgaaaaacagccttctggcgttttaaacagaaaggatacggagcatgatgaggcgctggcgaaacggccagccgagccgtcaggtaacaaagtgccatttgagtcaggcgttcaacagccggaaaaagaggagccttccttcccagctgaacatgccgaagagcaaacaccgcctgagatgctcacagatacggcggctgaagggctttcagacagtgaagtaggccgcgaagagcctgcaacggctaaggaagaacaaagggagcagcagtcagagaaatttgaagagcctgttttctccgctgaacttgatgaagagcaaacagctcctgaatctcagacagcggcagtatctgaggatgaaaaagcaaaagagccgtcagacagcccagtatacaatcatcatgaaaacgcggcagaaggtgctgagtccccgttcgttcaagaagaacaaatggacattcgtcaggaagagcctttattgactgatcatgagtattcatcagaggctctggctcaagcagaaactgtggcaaaagaatcagaagagccatcagaaagcataataaataatcattatgacaccctgggagaggctcaggaaacgaagatagatgttcagccagacagccatacagagcttgagaaaactgaacacatggagcagggttccaaatcgttttctgcaactcttgaaaatcggcagggaattcgcgcagacaaacctcgcgaagcttcagaagagccgaaaaaaaggcctgatgtacaggagaaaaggactgaacaaagcgcatcttctcaaaaagggccatccgttccttttaatgtgatgatgctgaaaagagatacgcataaacagcaaaaagcagaggagcgccgcggcagctatgtatttccgaatgttgcactgcttgatgtcccgccagcgcaggttcaagatgatactgcgtggatcgaagaacagcgtcagcttcttgatttgaccttgaaaaacttcaatgtccgcgccaatgtggtccatgtaacccagggtccgtctgtcacgagatttgaagtgcatcctgaaccaggtgtaaaggtgaataaaatcaccaacttgtccgatgatattaaactcagtctctcagcgagagatattcggattgaagcgccgattccggggaaaaacacgatcggaattgaagtgccgaaccgcacgagcaaggtggttgatttgcgccaaatgattcgcagctcagctttcaggacaagcaagtcaccgctcacagctgcgctgggattagatatttcaggaaatcctgttgttatcgacttgaagaaaatgccgcatggcttgattgccggcgctacaggctccggaaaaagcgtatgcatcaatacaatattagtcagcctgctttataaagctgacccgagtgaggtaaaggtgctgctgattgatccgaaaatggtagagctggccccttacaataaaattcctcacctcgtcagcccggtcattactgatgctaaagcggctacagctgctttgaaatgggtcgttgaggaaatggagcgccgctatgagctttttgcccattcaggtgtccgcgacattgaccgctttaatcaattaaccgctgaacaccaaatgggtgaaaagctgccatatttagttgtcattattgatgagcttgcagatttgatgatggtggctccaaacgatgtggaagaaagcattgcgcggatcgcccaaaaagccagagcgtgcggtatccatcttctcgtcgccactcagcgtccgtcagtcgatgtcattacaggtctgataaaggcgaatatcccaacgagaatcgccttttctgtttcaagccaggttgattcccgaacaattatcgacatagccggtgcagaaaagcttctcggaaaaggggatatgctctttttggaaaacggatcgggaaaaccggttcgtctgcaaggtaactttgtgtcagaccgggaaatcgaccgcgtcgtttcccacgtcagaagccaaatgccgccgacctatttatttgaacaagaagagctcgtaagacaaggatcagccctgaaagaagaggacgaactgttttacgaagcgtgtgagtttgttgtagagcaaaacagtgcgagcacttcaagcctgcaaagaagattcagaatcggttacaatcgtgcggcaaggctgatcgacatgatggaagcggaaggcatgatctctgaggcaaaaggaagcaagcctcgggaggtgctgatcacagcaagtgatttaataaacgaataatatgggttcattttcacaccaaacatggtatgatagtgtttagagcatttaacagctatgccgctttacagcagctgtgcatagacaaatcttgatatctgggtttaatcggaaagaaataacctgatactaaacataacaaaacatataaaatacgccgctaagggaggcttttcagccgccgcggtcgcaaattgaaatgagcgtcatatactggggaacagatagacgtttgttggaggtacaattatgactgtttatcattttgttggaataaaagggaccggtatgagtccgcttgcccaaatacttcatgataatggatatactgtccaaggatcggatatcgaaaaatttatttttacgcaaacagcgcttgaaaaaagaaatattacgattcttccttttagcgcggaaaatattaaacccggcatgacagtcatcgccggaaacgcattcccagacacgcatcctgaaatagaaaaagcgatgtctgagggaattccggtgatacgttatcataagtttttaggcgactacatgaaaaaattcacgagtgttgccgttacgggcgcacacggcaaaacgtcgactacgggtctgctggctcacgtgatccaaaacgcaaaaccgacgtctttcttaatcggagacggaacaggccagggaaatgaaaacagcgaatactttgtgtttgaagcgtgcgaataccgccgccatttcttaagctatcagccagattatgcgattatgacgaatattgattttgatcaccctgattacttctcaagcattgacgatgtatttgacgctttccaagagatggctcttcaagtcaacaaaggcattattgcctgcggagacgatgagcatctgccgaaaatccatgcgaacgtcccggttgtgtattacggcacgggggaagaaaatgattttcaagccagaaacatcgtaaaaagcacggaagggacaacttttgatgtctttgtccgcaatacgttctatgatacgttttatattcctgcgtacggccaccacaatgtattaaactcattggcggtcattgcgttatgccattatgaagaaattgattccagcatcattaagcatgctctcaaatcctttgggggcgtcaaacgcagattcaatgagaagcagcttggggatcaagtgctgattgatgactatgcccatcatccgacagaaataaaagtgacaatcgaggcggctagacagaagtatcctgatcgggaaattgtcgcagtattccagcctcatacatttacacggacgcagcagttccttgacgaatttgcagaaagcctgagcggcgctgactgtgtgtatttatgcgatattttcggctcagcccgtgagaatgccggaaagctgacgatcggcgatctccagggaaaaattcataatgccaagctgattgaagaagatgacacatctgttttaaaagctcatgataaagccgttctcatcttcatgggagcaggagatatccaaaaatatatgagagcctacgaaaacgtcatggcataataaaaagcagtgatctcactgctttttatttatctgatgggaaagcttattaaaggattttcttacataacggagaatagtatgtatacagcccagtacacatgtttatgattgaagaaaacgggtaaacagcagtatatcctgcagcaaggaggtttgagatgattattattctttatttgagcgttgcactcatcgcagttgcatttctcgtactagtgatctacttgtctaaaacattgaagtcattgcagctgacactaaaaaacgtcgcatccactcttgaagggctggagggacaaatgaagggcatcacaactgaaacagccgagcttttacataagaccaaccgcctggctgaagatattcaggaaaaatcagaaaagctgaacacggtcgttcatgctgttcaaggagtgggagcttctgtacagcagttcaatacatccatgaaacaagcggcagggtctgtatcggcatcagttagagagaatcaagataagatcaatcaagttgtcacttggagtcaagcagcaatggaaatttgggagaaatggaagcaaaagaaaaaatcagccctgtaagagaaaaaaatactaagaggaggaataatgatgagcaaagatggaattaatagtaaagattttttaatcggaactttaatcgggggaatcatcggtgccactacagctctttttctagcgcctaaatcaggcaaagaacttcgcgacgatctcggcagccaggctgttgccttacgggacaaaactgataaaatgacggcagatgcgaaggaaaaaggcacgcaatatgtcagcatcgcaaaagacaaaacttccaacatcacacagcttgtagcggatcagtctggacagatcatgaacaaggtaaaggatttgagagaccgttccaaatctgacaaaacggattcatcgactgcaatgcaagatatgagggaagaagcgatgcaggcagctgatgaaacaaaagatcaagtcctccagacgaaagaagatgtaaaagacgaactgaaagatgcacaaaaacaggctgagcagttgaatcgctgagcagggaaggaagagcttgagtcatggctaaacagcttattcaatctgaggaagaatttaaacggattgcagaacaggaaggcgttttcgtcttcttgaaacacagcaccacatgcccgatcagccaggcagcatttcatgagtttgatgcctttgcaaatcagcatgaggatgtgccggcttactatcttcaagtacaagaagcccggccgctgtccaatttcattgcagaaacatatggggtcaagcatgaaagccctcagatattcatcatccagaacggtgaagtgaaatggcatacctcacattcacaaattacagaagccgctattgagcagcatttgtcatagaaaaaagcgtccagatatcatctggcgcttttttttgtaaaaaacccttgaacattgccctcacatcatgtaggatagcttcatagattactttatcacttaaaagcgtttgggtaataaagtagagtttttataaaattttttgtatttcagtatttccatttggaattacttatagtaagatgcatgataactacaaaataaaaaatgaatgtgcagggaaaggatgaaaaaaatgagcaacacagagttagagcttttaaggcagaaagcagacgaattaaacctacaaattttaaaattaatcaacgaacgcggcaatgttgtaaaagagatcggtaaagcgaaggaagcacagggtgtcaaccgatttgaccctgtcagagaacgcacaatgttaaacaatatcattgaaaacaatgacgggccgttcgaaaattcaaccatccagcacatttttaaagagatattcaaagccggtttagagcttcaggaagaagatcacagcaaagcgctgcttgtctcccgcaagaaaaaacctgaagatacaattgttgatatcaaaggcgaaaaaatcggagacggccagcaaagattcattgtcggcccatgtgcggtagagagctatgagcaggtagctgaagtcgctgcagctgcgaaaaaacaagggattaaaattttgcgcggtggagcctttaagcctcgtacgagcccatacgatttccaagggcttggtgttgaaggccttcaaattttaaaacgtgtagcggatgaatttgatctggcggttatcagtgaaatcgtaactccggctcatatcgaagaagcgctggactacattgatgtcattcaaatcggagcgcgcaacatgcaaaacttcgaattgctgaaagcggccggcgccgtgaaaaagccagtgcttctgaagcgcggtcttgctgcaacgatctctgaattcatcaatgctgctgaatacatcatgtcacaaggaaatgaccaaattatcctttgtgagcgcggaatcagaacatatgaaacagcaacgagaaacacgctggatatttcagctgtgccgattttgaaacaagaaacgcatttgccagtctttgttgatgttacgcattcaacaggccgccgtgacctcttgcttccgacagctaaagccgctttagcgatcggtgctgatggcgtaatggctgaggttcaccctgatccgtcagtcgcactttctgactctgctcagcaaatggcgattcctgaattcgaaaaatggctgaatgaactgaagccaatggtgaaagtcaacgcttaattgaacaatccaaaaggccgcgcctgcggcctttttttatgctttctcgtttatttagttataaaaaccaagtatacgttttcatcatctataaaaacgtgtataatttcatgagaagtaattaaatttgatgaataatgaaaaataatgtacactactgacttacgcttacaaatcataaacgacataaattcggacattatgacatttctctacataaagtgtttatgctatagataaggataagtgtatccagtaaaaggagtggttttaggatgagcaatattacgatctacgatgtagcgagagaagctaatgtaagcatggcaaccgtttcccgtgtcgtgaacggcaacccgaatgtaaaaccgacaacgaggaaaaaagtcttggaagccattgaacgtctcggttaccgtccaaacgcggtggcaagagggctggcaagtaaaaaaacaacaactgtaggtgtcatcattcccgatatctcaagcattttctattcagagcttgcgcgcggaattgaagatatcgcgacaatgtataaatacaatattattttgagcaactctgaccaaaacatggagaaagagctgcacttgttaaacacaatgctcggcaaacaagtggacggcatcgtgtttatgggcggaaacattacggacgagcatgtggcggaatttaagcgttctccagtgccgattgtacttgccgcttctgtagaagagcaggaggaaacaccgtcagtcgctatcgattacgaacaggcgatttatgatgccgtgaagcttttggttgataaaggacatacagacatcgcgttcgtttccggaccaatggcagaaccgatcaaccgttcgaaaaaactccaaggctacaaacgtgcgcttgaagaagcgaaccttccgtttaatgaacaatttgtagctgaaggggattacacatatgattccggactcgaagcactgcagcatctgatgagcctggataaaaaaccgacagccattctttctgcaactgatgaaatggcactcggcattatccatgccgctcaggatcagggcttatccattccggaggatctcgacattatcggttttgataatacaagattaagcctcatggttcgtcctcagctttcaacagttgttcagccgacatatgatatcggcgccgttgcgatgagactgctgacgaagctcatgaataaagagccggttgaagagcatatcgtcgaactgccgcaccgtatagagcttagaaagtcaaccaagtcataagaaaaacaaagagcaagcttcacctttatggtgaattcttgcttttttcatggggagaaatgatgaaacgttttgattatcttacacctgttggatttgtgttaggaacgattattattgttatcgggattatttcaggatcgggagtaagcggtttccgctcttttcttgatctgacctctttcttcatcgtaacagggggactttgcgccgctgtttttatcagttttccgccaagagagctgaaaaaagcgccctctgtgttaaagcaggcattcatccgccaggaagacaatgtgaaagatcttgtgaaaacctttgtttccctttccgatcacgcgcgaaaacacgggcttttatcattggatgatcaggctcgggaaatcaaagatccattcttgaaaaaagggctgcttttagcgattgacggctgggatgaagaaacgattcggctcgtcatggattcagaaatcgcagcaatggaggaacggcaccgaaaagggcggcgagtttttgaaaaagcgggagaattcgctccggcatggggaatgatcggaacactcgtcgggcttgtgctgatgctcaaaaacttaaatgacccgcatatgcttggaccaaatatggccattgcgcttctgacgactttatatggttcattactggcaaatatggtcttcaacccgatcgcggctaagcttgaagagaaaacagaaagtgaaattttcatcaagcaggtaatggtggaagggattatcggtgttcaatccggaaaaaacccgcgcaaccttgaaagccagctggtcgttttcagctcacgggaagaatggcagaagcagccaaaacaagtaaaaacaaaaaagggatctgtacatgaagcttagaagagaacgttttgaaagaaggaatggaagcggaaaaaacagtcaatcttcatccagctggatggtaacctttacagatttgatcaccttgatccttgtgttctttattttactcttttcgatgtcccaaatcgatctgcaaaaattcaaagctgcagtggactcgatccagaaggaaggcaacgggcttcagccggaccaaacatccatagaaaaaaagaatacatccccatctgatacgaagaagcaagaggatcagcaggatcagcttctcaagaaagtaaatacatatataaaagacaatcatttgaaggcccaaatgacagccaaacgggatgaacgcggtgtcgtgctcgttcttcaggaggctgtgctgtttgatacaggtgaggcaaaggtgctgaaaaatgccgaaacacttcttcaccaaattgccgttcttcttcaaaccattccaaatgacattcaggtggagggacatacagacagccgaaacatttcgacataccgatacccgtcgaactgggagctatcagcagcacgggcaagtggggttattcaatacttcacgtctaaagagaagcttccctccaagcgctttattgctgtcggttatgcggatacaaagccagtaaaggataacaagacaaatgaacacatgaaggaaaatcggcgtgtggaaatagtgattaaaaaatcaaaaacgacctcttcgtaaaggtcgttttttactttgttctttgctgttcagaacgtatcgcatataatgctttgctgacagtttgggcatttttttctgtaatttcaggcttgcggggaatcggaggatataaatcagccggatcgctccagctcgacggaagggccacggggcattgtttttgccatttagcaatccattccggcgggatctcgtgtcccggatcaattcccttcatttcaagccatattctggcccaggcgcggggcacgacacgccaaatatcatatccgccccctccgactgcaatccatttccctccgcaatattgatgagccaaagtgtgtgcaagacgggggatttcttcgtatatattgattgttgctgataaatgcgtcagcgggtcgtagtaatgggcatcggcgccgttttggctgataatgacatcaggctcgaaatacgcggcgacttctgaagctgctgtccggtaagcctcaagaaaagaatcatcctctgtaaaagcgtcaagcgggatattaaaggaatagccatatccttttccgctgcctttttcttggatctggccggttccagggaataaataccttcctgtttcatgaatggacagcgtgcatacgtcaggattatcgtaaaatgtaaattgcacaccgtccccgtggtgggcgtccgtatcaatataaagcactctggcgctatattttttctggatatattgaatcgccacagcgctgtcgttgtatatgcagaatcctgatgctctcccgcgaaagccatgatgaagccctccaccaaggtttgccgcatgcagggcttgtcctgacatgacccagtctgcggccgttaaagtgccgccgaccaagagtgatgccgcttcgtgcatgccggcaaagacgggtgtgtcttcagtgccgagcccgtagctttctccttcttcagcgggaagctttccggcgcccgcaagctttacggcctgaatgtaatcgtccgtgtggacaagggaaagctcctcttctgaagcgagtctgggggtgacaatgtctccatcatcaaaggcattgatcgtcttaagcaaatcatatgttaacagaacccgctgctgattaaagggatgctcctgatgaaacatataggtttggtaggatggagaatagataaatacactgtctctcatagcagatccctttgctctgacggccatacgacgtggtgtccatttctttgtaatgcctgcaaaaacggcagcggattcatcgtttttacacggaagacaagcacttttacaccgggatcgtcatgcggataaacaagcacgcttaatattttcacttgaaggtcttggcaaagactgctgatctcagcgaggcttttggtgatgtcgtttacttttatctcaatttgcgatcccggctggtcagcgcctgtcaatttgacaaacgtccgcagcaaatcggtttttgttaaaatgcctattaatttttgatggtgcaccactggaaggcagccgatgccatgctcgtagaacacggctgatatttcttcgacaaaatctaacgggtgggcgcagacaacatcctttttcataattgaatctacgcttcgtgtgagaaataggcttcgtttgttttcttcaaaaatactcgggctggcctgtttcatgtctctgtctgtaatcatgccgatcacgtgtcgttcttcatctacaacaggcagatgtctgatatggaattccttcagtttgcatatggctgtttcaagcgtatctgtcttcgttaatgtaatgacatctcttttcatgatttgctcaacaatcattattttttcccctttgccagtgtcagttaatacatataacgatgataaaaacggagcctgtcaaattgctcaattgattcttggctgacgttttttccaatgcgggccatcagacagtttgcagggtgggagctgatctccggctcatccgttgcaaaccagaccaatccgcctgcattcatcatcttttccatgatctttctgtattcccacacatctttgttcatcccttttaaatcccaatgccagtaatattctgtcgtcatcacaatgtagttttccatttgttcatccatcatgctgacggtcaggagcgtctttccgacagcgcatccccgatagtccggcgctacttcgatggctccgagctcaatcaaatcctccatatttccttcagaccatctttcgagcgggtcaggatataaatacgtgacatagccgacaatggttcggccgtctctggcaataataatgcgcccttcgggaaggcctgcaatgtcgactagcgcttcatgctgctcgcgaggcgggcgaaatgcggttaaatctttatgaaactcataacctgccaaatcctctggagagacaggcccttctatcagtatagagccggttgctgttttgatgtttgctgaatggtatgttttatgatgttccactaattcaccgtcccatcaattcttataaaaatacatgccttctttaagaataccaaattataaagcgttttcaacatggtttatattttaaaaattgagaagaatatgaacatatactataataattgtgacaacttcagcaaagggggatgtttgggcatgaatttgaaagcgttaccagcaatagagggggatcataacttaaaaaactatgaagaaacgtaccggcattttgattgggccgaggcggagaaacatttctcttggcatgagacagggaaactgaatgcggcgtatgaagcgattgaccgccatgccgaatcgtttcgaaaaaacaaagtagcgctttattataaagacgcaaaaagggatgaaaaatacacgtttaaagaaatgaaggaagaatcaaacagagccgggaatgtgctgagacggtatggaaatgtggaaaaaggggaccgcgtttttatttttatgccgagatcacccgagctttattttattatgcttggcgcaatcaaaattggcgccatcgccgggccgctgttcgaagcatttatggagggagcggtgaaagaccggcttgaaaacagtgaggcaaaggttgttgtcacaacacctgagctgctggagagaataccggtagacaaactgcctcacttgcagcatgtcttcgtagtcgggggagaggctgagagcggcacgaatatcatcaattatgatgaagcagcgaaacaggaaagcacaagactggatatcgaatggatggataaaaaagacggctttctgcttcactatacatcaggttccactggtacgccaaagggcgtgctgcatgtccatgaagcgatgattcagcaatatcaaacaggaaagtgggtccttgatttaaaggaagaagacatttattggtgcacggctgatccaggctgggtgacaggtacggtatacggcatttttgcaccgtggctgaacggagcgacaaatgtcatcgtcggcggacgtttcagcccggaaagctggtatggaacgattgaacagcttggcgtcaatgtctggtacagcgcgccgacagcttttcggatgctgatgggagcgggagatgaaatggctgcgaaatatgatctaacttcactccggcatgtgctcagtgtcggtgagccgctaaatccggaagtcatcagatggggacataaagtttttaacaaacgaattcatgatacatggtggatgacagaaacgggcagtcagcttatctgcaactatccttgcatggatattaaaccgggttcaatgggtaagccgattccaggagtggaggcagcgatcgttgacaatcaaggcaacgagcttccgccgtaccgaatgggcaatctcgccatcaaaaagggctggccttccatgatgcataccatttggaataaccctgaaaagtatgaatcgtatttcatgccgggcggctggtatgtgtctggggattctgcttacatggatgaagagggatacttttggttccaaggcagagttgatgacgtcatcatgacctccggtgagcgcgtcggcccatttgaagtggaaagcaagcttgtcgaacatccggctattgcagaagcaggcgttatcggaaagcctgacccggtgcgtggagaaatcattaaagcttttattgcactcagggaaggatttgagccgtctgataaactgaaagaagagatccgcctatttgtaaagcagggtcttgcagctcatgcggctccgcgtgagatcgaatttaaagataagcttccgaaaacccgaagcggaaagatcatgaggcgcgtgctgaaggcatgggagcttaatctgccggctggagatctgtcaacaatggaggattaaaaggcggcgttgacacaggattttatttatgttaaaaatgatatagcttcatatgaaaaggtaaagattgagacaagtagaatatccttacgttccagagagctgatggccggtgaaaatcagcacagacggatatatcgaatacactcatgaaccgcttttgcaaacaaagccggccaggctttcagtagtgaaagaacggacctgatccgttatcaggcaaagtgataagacgaatgtttgcattctcttattagtagggtggtaccgcgataatcaatcgtcccttcgtgtaaacgaaggggcgttttttattttaattaaaaaaggagctttatcttatgactaacttacttgaagacttatccttccgcggattgattcagcaaatgacagatgaagaagggttgaataaacagctgaatgaagaaaaaatccgcttgtactcaggctttgaccctacagcagacagcttgcatatcggacacctgctgcctattttaacacttcgtcgttttcagcttgcagggcatcatccgattgcgcttgtgggcggcgcgacgggcctcatcggtgatccaagcggaaaaaaagcagagcgtacattaaacactgctgacatcgtatccgaatggtcccaaaaaatcaaaaaccagctgtccagatttctagattttgaagcagcagaaaacccagctgtcatcgcgaacaactttgactggatcggcaaaatgaatgtgatcgatttccttcgtgacgttggtaaaaatttcggcatcaattacatgctggcaaaagatacggtcagctcaagaattgaatccggcatctcgtacacggaattcagctacatgattcttcaatcttatgatttcttaaatctttacagagacaaaaactgtaaactgcaaatcggcggaagcgatcagtggggcaacatcacagcgggtcttgaactgatcagaaaatcagaagaagaaggagcaaaagcgttcggcctaacgattccgcttgtcacaaaagcagacggcacgaagttcggaaaaacggaaggcggcgcgatctggcttgataaagaaaaaacatcgccatatgaattctatcaattctggatcaacacagacgaccgtgacgttgtcaaatacttgaaatacttcacgttcctttcaaaagaggaaattgaagcatacgctgaaaaaacagaaacggcgccagaaaaacgtgaagcgcaaaaacgcctggcagaagaagtgacatcacttgttcacggacgcgaggcgctggagcaagccatcaacatctcccaagcgctgttcagcggcaatattaaagagctttctgctcaagacgtaaaagtaggctttaaagatgttccttctatggaagttgacagcacccaagagctttcacttgtagatgtgttggtgcaatctaaattatctccttctaaacgccaagcgcgtgaagacatccaaaacggagctgtttacattaacggtgaacgccagacggaaataaattataccctatcaggtgaagaccgcatcgaaaaccaatttactgttctgcgccgcgggaagaaaaaatacttccttgtgacgtataaataagaaaaagatcctttgccactgaaggcaaaggatctttttgtttaccgcataggaatgaaaggaaaagagtatattagatagggcaaacacgaccaatcaccaccttttaaatgaaaggagcgctaaagcgtgaatctcatgtgtacgattgcaaaagaacggctgcagcgggatcattgggagcagcaggcgcaagatagtgttggccagcaagaggcgaatgacgaaacagacgataaaaaaaccccgaccgcatagcggcaggggtttttaaaacgattaacgagagtagaactcaacgataagcgcttcgttaatttccggagcaagttcagaacgctcaggaagacgagtgaaagtaccttcaagcttttcagcgtcgaaagtaaggtattcaggaacgaagttgttcacttcaacagattctttgatgatagaaaggtttcttgatttttcgcgaacaccgattgtttgaccaggtttcactaggtaagacgggatgtcaacgcggcttccgtctacaagaatgtgaccgtggttaaccaattggcgagcttgacggcgagtacgtgctaaacctagcttgtacacaacgttatcaagacgagaatctaaaagaatcatgaagttttcaccgtgtttaccagctagtttgccagctttgtcaaacaaagtgcggaattgacgttcgtttacaccgtacatgtgacgaagcttttgcttttcttgcaattgcaaaccgtattctgataattttttacgttgtcctgggccgtgtggacctggagcgtaagggcgtttttctaattcttttcctgtaccgctaagagagattcctagacggcgggacagtttccaagatggacctgtatagcgagccataatgtgactcctcctttggttttatttttgtggaaaataaaaaccgtctgctctattcgaccatgcacattttgttttcatgtatcctcgctccagcagcagagagttacacgatacaccttatcgataaggaacaaaatgaaaacatagaagctgaacaaaaaggctgcaatatttcacacaaaggtcattatataatttatttgttttgaagtcaaccattcctccattattgcttcaccgtttatgatataataaacaaaaattagtggtaaacttttaggtgataaaaacatggtagaacaaactaaagatcaattatccgcctttcattatcatatgctcgattttttattaaccaaatctgaaaaagtcacattcaccgactctttcatatggctgacttcggctattcaaacctatttttcaaccctttgtgtttcgcttacaccgtcatcatcagactttgtgacaaaactggcagatggtgaagcgcgtttttccgcttcgaaaataaacgcttcatgttacctgattgaggacggctccggcaggcgtttccatcttgcatgcaggcaggatgaagagattcctgaagggcttccggacgtggttgcttcatttttaaaccagtcgatgaaacaggaaagactctataacaaaacgatctaccaaaaaaagatatacaaaatgacagagctgttccattcactgcttgatcagacagatgtgctgaagcagcttttagaaagcttgacaagcacattttctctttttgagttttctttatttatatcgcacgatcaagaccaatgtttagggattcctgcaaaagagctgtatatggaaggggaaaaatccgattcctttgcgctcaaagtgtatttgtccggagacattttgcggaaaaatgaatctgtcgcctatattccgatcaaaggacagcagggcacatacggggtgttgaaggctgaaggaacgggtgacagctttcttactgatgcctgccttgatgaaatgtcgctgttagcaaacgccgcgggaaaagcgtttgaaaatgcccagctctacgaacaatccaaagcaagcatcgcaaatttggaattgattaatgagacatcacgacgcctgaatcagcggatgacattgactgatacaatgaatgatctggctgtgagaatggcagaatcatttcaggcagaagaagtgggattttttcatatagaccattttgaaaacctaacattgcttccaggcagcacagcattttttaaagaagcgaagccgtcagatttttataatgagctgaaagaaaagctgtatgaaggtgaaaaaggggttttcatcgggaatggccagtctgtttttgggaaggtggggtacggctcgctgatggctgctccgatgattcaaaacgaccggcttttaggctttgcggttttattgaaacaggagctgtacgcttttacatttgaaatgtacaagctgtttcaggcgctgattcatcacgcgacactggctgtaaccaattcaatgcttcgcgaccgccttgagcatctcgtgaaaacagatcagctgactgaactgtattcacgagcgtatttagatgaaaaaattcaatacagcatgaaaatccaccaaaagggtgtttttattcttgttgatattgataattttaagaatgtaaatgatacgtacggccatcagactggggacgagattttaattcaagtcgcttcagtgattaaaagcaacatccgaaagcatgatgtcggtgcccgctggggaggagaggagctggcgatttatttgccaaatgtgccggttgcagtggggaaacggattaccgagcggctggtttacgcggtcagaaaaaatacgaaacccgaggtaaccatttcctgcggtatctcctgctggacgacagaaacaaaaaagtcgctgaaagagcttgtgcatgaggcagacgaagcgctctacagcgcgaaacggagcgggaaaaaccgcttgatggttcatgactcaataaaataaaaaaagcccaaaacgatatcagttttgggcttttatattactgcgctaacgctttttctagcgtttcggcaaattgagttaagtatttttcatcaatttcgtcgaaacggtttttcactgggctgtcgatgtccaagacgccgacaatttttccgtctacacgaatcggaagcacaatttctgattgagacgctgcatcgcaggcgatatgtcccggaaacgagtttacatcctcaacacgttccacttttccgtttgcgtacgctgtgccacaaacccctctgccgaaaggaatccgaacacatgccggcaggccttggaacggacctaacacaagctgtccatcctcttctttggcaaaatagaaacccgcccagttgacttcaggcagcgaatgatacagcagtgctgaggcatttgcatagttagctatttggtctgtttcgtcttcggtcatggcttcgagctgttttagcagaagctgatagcctttttctttatctccagattgtttttcgacatggaacatggaaaaccctcactttttctataatataaaacaaagttccggcttttctgccggcatttgtcgataagttcttacaggaacagcggctttctgcttgaatagtatcaagaggaaggagtgagccgtatgaaagtaagcaccaaagacaaaattattgaatctgctgtcatgctttttaaccaaaaaggattttctggcacgtctgtccgtgaaatcgcaaagtcagctgatgtaaatgttgcgcacatctcctactattttaaaggcaaaggaggcttgatggaacacttagtttcagagttttacgagggctacagcaaaacgcttgaaacagcggcaagcaatatctcttctcaaagcactcaggaacagcttcttcaattggttttcgatattttatcctatcagcataatcatcgtcaattaactcgttttgtctaccgggaagtcacaattgactccacattaatcagggaaattatgtcgacatatctaatgaaggaaaagtatatcttccagctgatcattgaggaaggagaaaaacagcgtgaatatttaacgctgccgctgcctcattttattctccaattaaaatctctcttgatgatgccctatctccagcctcaatatatttcagaagtactctacatgcagccgcacgagccgtatttttataaaatgtattttgaagaaatcaagatttggatcagaagcgtcttccggacaggagacgtggcgctcaccaactagcaccgttccaaaaacgcctcatacgcatatccgacatctcccgcttgatgggcatctgacccaaacacaagcgggatcttcttttgcttcgcttcattcagcatccaatcctcgatataaataccgccagcgtaagtttttcttaagccggaagtattgaagtcgagctccattccgttttcttcaatggcattcaggcacagggaaacgaggccgcgaatatgttctgacatgctgtatggaaacagcttgatgaatttttggacgagtgtgatgtgaccgactctttttggcttataaacgccgagagatgctacaatggaagaatagatactccggtaatattgttcatataccgcttcaatgcttccgcaggctgaaatcagctctttgaaggtatgctcgtcataatcaaggcatagataggaagagtctgtgcgcaaaaaatgaacggataagatgctgtcatctaaatatggcccgtatgtgtccaggaataatgtaatttcgtcttcaaattcagcgatataatcgacttcaagccctgtccgtatgctaagctgtccgcgatattctttttttaatccggaaatttcatgaatatagcgttccaaagaagcttgcgccatcgcgctgtctttcagcggcgtgggatcggtaaaagagggcggcaatggggcgtgttcggtaaaagtaatcgattcgaaccctttttttaaggcttcttctgcatattgtctgagtgtgtcattggagccgtgagggcaaaatggtgtgtgaatatgtccgtctcgcttttgcattgatgtcaccccatgaaaaaatagtcaaatcctgccgattttgcacaaaaagtttttgatttctggtcaaaaaatgtttgttacatggtatcataataacaatgaaaacgacagtttttctcaatacatatcctgaaatctttctgaataaataaaacaccctgacagattaaggtaaacagcaagggggctcattatggagtttgtcattggattattaattgtactgcttgcgctgtttgcggcaggctactttttcaggaaaaaagtctacgccgaaatcgaccggctggaatcgtggaagattgaaattctaaatcggtcgatcgtggaagaaatgtctaaaataaaacatttaaaaatgacgggtcagacagaagagttctttgagaagtggcgtgaagaatgggatgagattgtcacagcccacatgccgaaagttgaagagctcctttatgatgccgaggaaaatgcagacaaataccggtttaaaaaggccaatcaagtgctcgttcatatcgacgacctgctgacagcggctgaatcaagcattgaaaagattcttcgggaaatcagcgatcttgtcacaagtgaggaaaagagccgtgaagagattgaacaggtgagggagcgctattcgaaatctcgaaaaaacctgctggcttacagccacctttacggggagctttatgacagccttgaaaaggatctggacgaaatttggagcggcatcaaacaatttgaagaagaaacagaaggcggaaactatattactgcacgaaaagtactgcttgagcaggaccgcaatcttgaacggcttcagtcatacatagatgatgtgccgaagctgttagctgactgtaaacagacggtgcccggacagattgcaaagctcaaggatggctatggcgaaatgaaagaaaaagggtacaagcttgagcatatccagcttgataaggaattagaaaatctgtcaaaccagctgaaacgagcggaacatgtcctgatgactgagctggatattgatgaagcgtccgcaatcctgcagctcattgacgaaaatattcaatctgtttatcagcagctggagggcgaagttgaagccggtcaatccgtactaagcaaaatgcctgaattgattattgcttacgacaagcttaaagaagagaaagagcatacgaaagcggaaactgagctggtgaaggaaagctacaggctgacagccggtgagctcggcaaacagcaggcttttgaaaagcgccttgatgaaattgggaagctgctatcatccgttaaagataagctcgatgcagagcatgtcgcttactcacttttagtggaagaagttgcttcaatagagaagcaaattgaagaagtgaaaaaagagcatgacgagtatcgtgaaaatctgcaagcgctgagaaaagaagagctccaggcgagggagacgctcagcaatttgaaaaaaacaatttctgagacagcaagactgctgaagactagcaacattccagggattccgagccatattcaagagatgctggagaacgcgcatcatcatattcaagaaacagtcaatcaactaaacgaacttccattaaatatggaagaagccggagcccatttgaagcaagcagaagaaatcgtcaacagggcaagccgggaatcagaggaacttgtcgagcaggtcatcctcattgaaaaaatcattcagttcggaaaccggttcagaagccaaaatcacattttatctgaacagctgaaagaagcggaaagacgtttttatgcttttgattatgacgactcttatgaaattgcagctgccgctgtggaaaaggctgcgccaggtgcagttgaaaaaatcaaagctgacatatccgcttagataatcacgaccatgaaaaagagcccgcagtgtaatgagcaggctctttttttcattgcaaaacgcctgcgcaataacgcaggcgttctgtgacattaacttatttcattaagctgtttggatggtccgatgaataaggtcagcacatagccgataaccgctccgacgattcctggaagcacccagccgatgccgaggctgtaaagaggaagattcgcatttagaaacacatctaaagatccaagtgagaaaccggctgctttgataccgtctaaaatactgaaaagtcctgtaccgatcaagcatgcgatgtacacttcgcgtctttctttaaagatcttatcgatgaaggaaagaacgataatgacaatggcaagcggatagatagctgataaaataggaacagaaaacgcgataatttgcgcgagtccgaaattcgcaatgatcaagctgaataacgtgacaatcgtaacgacaattttatatgataatgccggaataagttttgaaaaatattggccgcaagatgtgacaaggccgatgcttgttgttaaacatgcgactgtaatcgctgctccgagtacgatgttgcccaatgaaccgaataaataatgggaagatgcagataaaattttagctccttcaccaacaggaccgatggcatttgtgcttgttgcacctaaataagcaagggatacataaatgaaagtcagccctaaagcggcaatcacacctgctttaatgcaggctgcagcaagagctttagactgtgtaacgcctttgctttttacagcatttacaacgacaacgccaaatacaattgaagcaagtgcgtccattgttttatagccttctaaaaatcctttaaaaaccggtgttcctttatatgcttctgtcacggcgcccaatccgcccatcggcgtgaagatggctttgagaacaatgattaaaataatcgtgaatttgatgggagtcagaatttttccgactcgatccacaaccttggatgggtttaacgctaaatagtacgtaacgccgaaaaagataagtgtaaatattaataaagaaagtctttctggtacgccagtcaaaaacggaacagcgccaatttcatatgaaacagttcctgttctcgggatggcgaataatggtccgattgataaataaagcacgacagtaaagattgtaccgaaaactgggtgcgctttgtcagcaaggccttttgcgtccttaccggttaatgcgatggcgataatgccgagaagcggcaggcctacccctgttagtaaaaatccgccgatggccttccagacgttgtgtccggctgcttgtccaagttccggcggatagatcatatttcctgctccaaagaataacgcaaatagcatgaaaccaataataatggtatctttgacaggcagtgagtgtttcatgaaaaaaatcctcctaataattatgttaaaatattctgtcaattaattgtcagataatatgacgaaacgaacaaatcttattatatggtaaaaaaattagaagtcaatactagtttttcgtaattttctattaaattttgttatggtaacataaatatcataccttgtaccgctttcataaaggagtaaaaaagatgatatatttagataatagttcaacgacgaagccttacgatgaagtcttgaacgtatatgaacagacaagcagccgatactttggcaatccttcatctttgcaccgatatggagccgaaacggaacagctgcttcaagcagccaaaaatcaaatcaaaaggtccttaggcctaaaaaaatatgatattgtatttacgtcaggcgccacagaagccaataatgcggctttaaaaggagcggctttgtcaaagataaaaacaggcaaacatatcattgccacttctattgaacatccatccgttacggaatcgttagaacagctgaaagagttgttcgggtttgatatcacttatctttctgtgaatgaagacggatttgtttctattgaagatctaaaagcagccatccgtcccgataccgtgcttgtcagcatgatgcatgtgaacaatgaagtcggttccgtgcagccgattgaagcggcaggagaagtgctgaaagagcattcgaacattttgtttcacgtcgattatgtgcagggcatctataaagtgcccttggcaattgaaaaggccggcattgatctatgttcaatttcggggcataaatttcacggcctaaaggggacaggcgcacttattgtaaaagaaggaacacgccttattccgctcataacgggaggctctcagcaaaaaggcatacgggccggaacagaacatactgctggtgcggtttcgcttgccaaggccattaatcttgcctctgctgattttgacacacggcttgacacgatgactgccgcaaaggaattgtttatgaaaaggctgagtgaaattgagggcgtcgttatcaacacgcctcaaatgaatagcgcaccgcacattattaatttctctgtaccggggattaaagcggaagtgcttttacacatgcttgaggaacaggatattttcgtctccacaacatcagcttgctcggcaaaagaacataaacccagcaaggttctcttagagatgggcaaaggcgagcagattgccggaagcagcatcagaatcagtttaaattacagccagacaagcgatgtggcagaaccgtttatgaacgcgcttcgtcctggcatcaaaaaattaaggaaaatgatgaggtagaacatgaattacgatcatatattaattcgttttggggaaatttcgaccaaaggcaaaaacagaaaaagctttattgagcgcttaaaacaaaacatcagactcgttttgaaagactatccgaatttaaaatacttttccaacagggatcgtatgacgattacattaaatggagaggatcctgaggctctttttcctcatttaaagcaagtgtttgggattcaaagcttcagcctggcaattaagtgtgacagccgccttgatgatattaaggcaaccgcactaaaggctatcaaagatcagtataaaccaggtgatacgtttaaagtcgcgacaaagagagcgtataagcaatttgaattagatacaaaccagatgaacgctgaaatcggcggccatattttgcgaaatacagaaggattgacggtcgatgttcgcaacccagacatcccgctcagaatcgaaatcagggaagaagcaacatttttgacaattcgtgatgaaaaaggtgcaggcgggctgccagttggttcagcaggaaaagcgatgctgatgctttccggcggttttgacagccctgtggccggtttttatgcgatgaaacggggactgtcggtagaagctgttcatttcttcagcccgccatacacaagcgagcgcgcaaagcaaaaggtaatggatctggcgaaatgtctgtcccgttttgggggaagcatgacacttcatattgttccatttacaaaaacgcaagagctcatccaaaaacaaattcctgaaaattacacaatgacggcaacccgccgcctcatgcttcagatcgccgacagaatcagagaaaagagaaacgggcttgccattattacgggagaaagcctcggtcaggtagcgagccaaacgcttgaaagcatgtatgcaattaatgcggtgacgtcaacaccgattttgcggccgttaatcgccatggacaaaacagaaatcatcgaaaaatcacgggaaattggcacatatgagacaagcattcagccgtttgaagactgctgcacgatctttacaccgccaagcccgaaaacacgccctaaaaaagagaaaattgaacactttgaaagctttgttgatttcgagccgtatattcaagaagcggtagataacattgagacaatgaccctgtatagcgaacaagaagctaacgataaattcgctgaactcttttaaatcaattttcagctcctgtatacaattaccaaagtttttctgaatgaagccatgtgttttgacacattctatactcacaaggaggtgagacacatggctaacaataactcaggtaacagcaacaaccttttagtaccaggagctgctcaagcgatcgaccaaatgaaattagaaatcgcttctgaattcggtgtaaaccttggagcagacacaacttctcgcgctaacggttctgttggaggagagatcacaaaacgtcttgtatcttttgctcaacaaaacatgggcggaggacaattctaatttacaatttcacataatggcttaggagtgggggtatccccactccttttcattttttacatataaaaaaggaccagcggcctataaaatctatgtttacagaggttgcttttaggcatatccttacggaaagagcctgtatttatgtataatgggtggagaaagtgaggagttgttcgtgttaaaacgtgaagatttaattgcccctgtgcaatataatttagtgaatgaaatggaaaagttcagtgccgctggacaaaaaaccgctcttctgtgggaggacgagtcgggtaagcaagaatcttggtcgtatgaaaagctgatggaagaaacaaataaaatcggagcggccttagctgatcttggatttaaaaagggagacaagctgattgtaatggttccgcgggtgcttgaagcctatgccgtttatttggctatcctgaaatcaggaatggtcgttattccatgctccgaaatgcttcgcgcgaaagatcttgaataccggattgaacatgcagaggtaaaaggcgccatcgtctactcagaatttattggcgctttccgggatgtcagtacgactgacaaactgattacactgtctattggtgaaaatgatgccggctggaaaaacctcttatcaattgaagcggacggaagccaatttaaaacagctgacacaacaagagatgatatggctttcttatcttatacatccgggacaacaggtcagccgaaaggtgttgtacatacacatggatgggcatttgctcatttaaaaacttctgccggcgcttggcttgatatttctgaaaaggatatcgtctgggcaactgctgcccctggctggcaaaagtgggtatggagtccgtttttagcggtgcttggcagcggagcaaccggttttgtgtaccacggcagattcaaagcagaaaaatatctagagcttttaaatcgctacaaaatcaatgttttctgctgcacgccgacagaataccgcttaatggcgaaggttgaaggcttggaccgctttgatctttctgccctgcacagcgcagtttccgcaggtgagccgctcaaccgtgaagtcattgatgttttccaaaagcactttggcattaaggtacgggacggatatggccaaacagaaagcacgcttttggttggtgttttgaaagatacgcctattaaaccgggaagcatgggaaaaccgacaccgggaaaccaggtggagatcataaatgaagacggtgaaatctgcaaacctggtgaggttggcgatatcgctgttcacctcagtacgcctgcgctctttaaagagtattttaaagatccggaaagaatgaaaacacaaattcgcggcgattatttcctaacgggagacagagcaagaaaagatgaggaaggttacttctggtttgaaagccgaaatgacgatattattatcagctccggctatacgatcgggcctttcgaggtggaagacgcgcttgttaagcacccagaagtaaaagaatgtgctgttgtcgcaagtcctgatgaaatcagaggctccatcgtaaaggcatatgttgtcctgcaaaatcatgaaaaacgcagtgatgagcttgtcaaaatgctgcaaaaccatgtgaagacgattaccgctccatacaaatatcctagagaaattgaatttgtggaaagcctgccgaaaacggcttctgcaaaaatcagacgagtggaattaagaaaacgtgaagaacagctcaaagccaataaaaaggcgtaaagaaagagagtgaacgtgaatgaaggcgatatggcacggcggtttcatttatacgatgctcaaagaaggtgatcggactgaggcagtttatgttgaggatggtgtcataaaaggcaccggcagctatgaacgtttgaaggaaaagtacgggtcgccggaaacagaagaaatcagcctgaacggagcagtgatgttccccggttttgttgacagccatctacatttgatcggccacggtgagaaacagcttcagctcgatctgtccgcactgacgtcgaaagatgcaattttacaggctgcgaaggaaagagagcggcagcttcctaaaaacgattggctcattggagagggctggaatgaaaatcagtttgagacacctgactacttgactaagcatgatcttgatcgcctgtttcctgacaggcctgtcttgctcaagcgtatatgccggcatgcaatagctgtcaattctgcggctcttcaagcagcgggaatttcaagaaatactcctgatcctgacggcggagtcatcgtaaaagatgcaaatggcgagccgaccggactcctgtttgataaggcgcaggatttgattctgaacgctgtcccgccagtctcccagcactacgttgatgaggcattaacggctgcaataaaggattgctggacaaaaggcctgacgggcggtcattcggaagacttgtcctattatggtgatgtttcggtgccgatgaacgcttatgagaaagctgtcgctggcggaaagtatccgttccgctgccatttgctcgttcatcatgaagcggtcgatcgatgggagcagctggataagccgtccggcccttatgtggagtttggtgcgatgaaaatctttgcggacggggcgcttggcgggagaacggctttgttgaaagaaccatatcaggatgatccatcaacaaatggtgttcaggttcacgatgacgaaacccttggccggctcattcgcaaagcgagagaaaaagggatggaggttgctgttcatgcaatcggcgatcttgcttttgaaaaagtgctgaacgcaatagaaaagcatccgcccaaaaacggccggcatgatcggcttattcatgctcaagtgcttgataacgaattaatcgagagagcagcacgcatgccgatcgcacttgaccttcagccgcacttcgttgcaagcgactttccgtgggtcattgaccgtctcggaaaagaccggatgaagactgcttttgcctggaaaaccctcatatctaaaggaattttatgcgcgggcggttcagacgccccgattgagcctgttgacccgcttcttgggatccagtccgcggtcctcaggaaaagcagtcatgagcaaaacgggccaagctataatgaaagtgaatgtttacctgtatatgaagcgataaagctttatacagaaggtagcgccggtatcatttataaagagaagtcacgcggaaaaattgcggaaggctatgacgcggattttacagttctcagtggtgatccgtttgccattgaccccgcacagcttcatcttttagatattaaaaaaaccgtgattaacggccagattgtatatgagaaatcataaaaggacaggcagcagcctgtccttttattttctataaaaaagtacgcttcactttttcccaaaatgaattgtcctttagtttgactgttttgattttcttattagacagtttgatttcgatcgttttcacatttctcgtgctgagtgcttcattgtccaagccgatgattgggtgttcgttgccgtcctgcaccacacgaagggtcagctttcggtcagagctgaggacaaatggcgagccgagtgtccggtaggtattattgttaagggatgcaagctctgatacctgcatgcatggaagcaatggatcaacaacagctcctgcaacagacttgttataggcggtgctccctgtaggcgttgagataatcattccgtcacctctaaacgtttcaaagtgcagatcgtcaatcagcacgtccatcacaaaggttttaatgatgcttgagcggatggatacctcgtttaagcagtgaaaaggactggcatgatccactgtcacttcaatcagcgggtattttctcacttcaatttgttcaaacgtcattgcatcgaccattttttctcgctcatcactatgaaagtcgcaatataaatgagctttcccctttttggtaatgccgacgtacaagcagtcatcacgaaaattcgtctttctgactgcctgcaaaaatgtgccgtccccgccaatgctagcgataatattagcgtctgagtgctggttcacaacggtaaatccatgctcctccgccaattgtgttaacgagcgggcttgttcgttcgtttcctgatcctgtttgtgaaaaaaataaacattacggcgttgatcggtcatatcccatttcccctttgctgtcatatttaagtttttctgccatccagtatttgtgataaaatacctttggccataagtgtaccacgtttgccggcagcccgttaagccggagctttctcatgaagtgaaacatttttcatattgaatcgtataatgagagagtttaggaaaaaggaggagaaaaaatgaatgcaaaaagatggattgcattagtgattgctctggggattttcggtgtgtctattatcgtcagcatctctatgagtttctttgaaagcgtcaaaggcgctcaaacggatctcacatcactgacggatgaatcgcaggaaaagacgctggaaaacggcagtctctcaagtaaaattgccgtattagaggtcagcggcaccattcaggataatggggactcaagcagtctgcttggtgcagacggatataaccacagaacgttcttaaaaaaccttgagcgcgcaaaagatgacaagacggtcaaaggtatcgttctgaaggtgaattctccgggtggcggagtgtatgaaagtgctgaaatacataagaaactggaagaaatcaagaaagaaacgaaaaaaccgatttacgtgtcaatgggttcgatggcagcatcaggaggctattacatctcaacagcggctgataagatttttgcgacaccggaaaccctgaccgggtcactcggcgtcattatggaaagcgtcaattattcaaagcttgccgataagcttggcatttcttttgaaacgattaagagcggggcccataaggacattatgtctccttcccgtgagatgacgaaagaagaaaaaaacatcatgcaatcgatggttgataattcgtatgaaggctttgttgatgtcatttcaaaagggcgcggcatgccgaaagcagaggtaaagaaaattgcggacggccgcgtgtatgacggacggcaggcgaaaaaactgaacctcgttgatgagcttggtttttatgacgataccattacggccatgaaaaaggatcacaaggatttgaaaaacgcctctgtcatttcttatgaggaaagcttcggattaggctcactgttttccatgggcgcgaacaaaatgtttaaaagtgaaattgattttttgaatatgagagaaattctatcgcaatccggttcgccgagaatgatgtatctctatgcgaagtaggagggaacaataatggacgcgacatatgaagagttagagcgcaatgacatcaaaggcccgcaagaagcagagcagctgacacatgcctatgctggcttttgggttcgtttctgggctttcctgcttgattggctcgtgatatggggattaaaccatttgctcgtttctcccctctttaccgtattggatctgccgaaaacatccggcatgtttaccttctcggcttacagtgtgacaacgcttattgtgtatcttgcctatttcgcactcatgacaaaatacttcaggcagacgcttggtaaaatggtgttcggcctcaaagtggtttctgtgaagcgagatagcaagctgacatggagtacagtgatttttcgtgaagtggttggacggtatattgataagatttggattttatatatcgttgttgctttttcacctacaaaacaagggattcatgattacatcgcggataccaccgtggtgcatgaaaaattataccgcaaataaccgataacccggacttccgtccgggtttatttttttaggaattggcgataatgctcctagaggaagtgaagaatatggtgtatgtactgacagccattcttattctcatagggatcgtactgcttctcagaatgaaaatccatgtcgcgctggagtatcttcatgccgatgataatgacaaattgaccttgaagattacggcgctgtttggccttataaggatcaaaaaaacaatcccggcgattaaggtgaacaaagaagacggaacagtggatatcaaacaaaaaactgaatccaaaatgaaaaaaagcagcggaaagaaaaaaattacacaaaacgatgtgcagcaaagcattaataaaatcgaaatgcttttgcatcaggtcaccagactacggaaaatcagcgcgtcttttctcgcgcatttacatatcacaaaactagaatgggttacagtaatcggaattcaggacgcggcagtgacaggtgtgttaacaggtgctgtatggggtgtgaagggcggtatcgcagcaatgctctacgaccacctggactttgtgaataaacctgtctatgaggtgatcccgtcgtttcaagtccctgtttccaagacccattttcagtgtatattcttttttcgctttggacatgctatgcttgcagctttcaaattcgtcaaatacggacgggagctatccgtattaaagaagaatccgtcggctagaatgacttcaaagaatgattcatcagtttaaggaggaagcgtatatggcagaccatcccatccaaggtttaatgaaaaccgcaatggaaaacttgaaggaaatgattgatgttaacaccatcatcggagatccagtagaaacgcctgatggaagtgtgattttaactgtttctaaagttggatttggattcgccgcaggcggaagcgagtttggcggaaagccggccgaaaagaaatcggaagatgatgagacaagagaacagaaacttcctttcggaggcggaagcgggggcggtgtgtccattacgccgatcgcgtttttaattgtcggatcgacaggcatcagaatgcttcatttagatgaaaatacccatttaatagagaaaattttagacgcagcccctcaaacactcgagcgcatccagcaaatgttcaagaaaaataacaaaaaccaaggccagggccaaaatcaaaaccaaatgaacaatatgaattattaaaaaaggttaactgcgctggccgcagttaactttttttttggcataaactttgcagtttgcaggaaactttactatgatagagacatacatacaaaagggaggaattataatggctgaaattacattcaaaggcggtccggttacacttgtcggacaagaagtgaaggtaggagatcaagctcctgatttcacagtgctgactaacagccttgaagaaaaatcgttagctgacatgaaaggaaaggtaacgattatttctgttatcccttcaattgatacaggtgtttgtgatgcacaaacacgccgttttaacgaagaagctgcaaagcttggagatgtcaacgtctacacaatcagtgcagaccttccatttgcgcaagcgcgctggtgcggcgctaacggaattgacaaagtggaaacactgtctgaccacagagatatgtcatttggcgaagcgttcggtgtgtatattaaagaacttcgtctgcttgcgcgttccgtatttgtccttgatgagaacggaaaagtcgtttacgctgaatatgtaagcgaagcaacaaaccacccgaactatgaaaagccaattgaggctgctaaggcattagtgaagtaagcagggaaaaaagctccaggctgccgccggagcttttttcatggcaaggaggaacacaatatgcaaaaagaccatgtaggtgcggtgtatgagctgttaaacgaagcagcgattatgataaagaatgaattgcagatttcatatatagaggcgcttgccgaagcaggagaaatgtattttcttgaaaaaacggatcagctgaaactgcctgctgatcagaaaaccaaacaacttcaggctctgcttgaaaaagcggaattcggcacgtatgagcatgagtgggtacgcaaggcttttcagcttgccgtccttaaaggaatgaaagatatctcccatccaaacaggcaaatgacgccggatacgatcgggcttttcatcagctatttggtgaataagtttatggcggacaaaaaggaattgaccattcttgatccagccttgggaactgggaaccttctgtttaccgtgctgaaccagctgtctgaaaaaacggcaaacagctttggcattgaaattgatgatgtgctcttgaagatcgcctatgcccaagcgaaccttctgaaaaaagagcttgagcttttccaccaggacagccttgagccgttgtttatcgatccagttgacacggtcatttgtgatctgccagtcggctattatccgaatgacgaaggagcagaagcgtttgagcttaaagctgacgaaggccattccttcgctcatcatctgtttattgaacagagcgtcaagcataccaaaccgggcggctacttattttttatgattccgaatcatttgtttgagagctcccaaagcggcaagctgaaacagtttttcaaagataaggttcatatcaacgcactgttgcagctgccaaaatctatttttaaagacgaagctcatgccaaaagcatccttgtgcttcagaaacaaggagagaatacgaaagcgccggggcaaattctgcttgcgaatcttccgtctttctccaatcaaaaggcgatgcttgatatgatggctcaatttgatgaatggtttaaaaaagaaaagtaagtgttttaaaagcagcttagacagccgtatgaggtcgatgcctaagctgcttttatttatgcttttgaagaccggacttgacgaattgaatccagctttgaaacacaaaatacagagggaaaaaccgcaaattgtaagcgttcatcaatacaaaacctatagggaatgtgtctgaaaataacgacttcttattgtaagcgttatcaatacgcaagttgacttgaaaagccgacatgacaatgtttaaatggaaaagtcagatatttttcggagaagatgttgatattcaccgggaaaaaagtacgaaaaacgaagttgttgatacagagtataaaggagcgtcaatcatgtccaaaattattgcaattaacgcaggaagctcgtctttgaaatttcagcttttcgaaatgccttcagaaaccgttttaacgaagggtttagttgaacgaatcggtatcgccgacagcgtattcacaatttctgtgaacggcgaaaaaaatacagaagtaactgatattccggatcatgcggtagctgttaaaatgctgctgaataagttaacggaattcggcattattaaagacttgaatgaaattgacggaattggccatcgtgtcgttcacggcggagaaaaattcagcgattctgttttattaacggatgaaaccattaaggaaatcgaagatatttctgaattggcaccgcttcacaatccggcaaatatcgttggaattaaagcgttcaaagaagtgcttccaaatgttcctgctgtagctgtatttgatacggcattccaccaaacaatgcctgagcagtcttacctgtacagcttgccgtatgaatactatgaaaaattcggcatccgtaaatacggcttccacggcacttcacataaatatgtaactgagcgtgcggcagagcttctcggccgtccgttaaaagacttgcgcctgatttcctgccaccttggaaacggagcaagtattgcggctgttgaaggcggaaaatcaattgacacatccatgggctttacgccgcttgccggtgtagcaatgggtacacgctctggaaacatcgaccctgccctgattccatacatcatggagaaaacaggccaaacggctgacgaagtattgaatacattaaacaaaaaaagcggactgctcggcatttccggtttctcaagcgatcttcgtgacatcgttgaagcaacgaaagaaggaaatgagcgcgcggaaacggctcttgaagtattcgcaagcagaatccacaaatacatcggttcttacgctgcaagaatgagcggtgtagatgcgatcatctttactgccggtatcggtgaaaacagtgtggaagtcagagaacgcgttcttcgcggtttagaattcatgggcgtatactgggatcctgcgcttaataacgtgcgcggcgaggaagctttcatcagctatccgcattctccagtaaaagtcatgatcattccgactgatgaagaagtcatgattgcgcgcgacgttgttcgtttagcaaaataaatcgcatgaaagcacattctcttgaatgtgcttttttgttgatgcatgatagtgacagacagaaaacataaaagaggtgggcctatgagcgttcaagagcataaacaagaagctcccgatatcgttcggtgcaaagtgattactgtcagtgacacgaggacagaggaaaccgataaaagcggcaagctgatgatctcatttttagaagaagccggtcatcatattgctgcatatgaaattgtaaaagacgaaaaggatgctttgcaacggtcagtgcttgcgggctgcatggatgaacagacagacgcggtactcttaaacggagggacaggcatagcagatcgggatgtcacaattgaagccataacgccgctgttttcgaaagaactgcccggctttggagaaatattcaggatgctgagttatacagaggatatcggctctgccgcaatcatgtcgagagcaactgccggcgtcattcagcataccgctgttttctcaacgccaggctcaagcggcgcggtaaagctggcaatgaataagctgattattcccgaacttgcacatgtggtcagagaaatcagaaaagacaagtaaatgaataaatactacgaaacttcacctgaaatttaggtgaagttttttttataaaaggcttgaaaaaacgaaacgtacttgttaaagtgtatacatacaaaatgtatttttattaaatataatttatttttatacaaaatagaaacacggttgagaggggatttttatcatgtcagaacagaaaaaagtcgtattagcatactcagggggtcttgatacttccgtcgcaataaaatggcttcaggagcaaggatataatgtcatcgcctgctgcctggatgtcggtgagggcaaagatttggcatttgttcagcagaaagcgcttgaagtcggcgcgacaaactcctacgtgatcgatgcaaaagaagaatttgcacaggattacgcgcttatttctttgcaggcccacacgatgtatgaaggaaaatacccgctcgtttcggcattatctcggccgctgatcgcgaaaaagctggttgaaatagcggaaaaagaagatgcacaggcgattgcccatggatgcactgggaaaggaaatgaccaggttcgtttcgaagtctccattaaatcattaaaccctgacctagaagtcatcgcgccggttcgcgaatggcagtggtcacgtgaagaagaaattgaatatgcggctagccgcggcattccgattccgatcaatcttgacagcccgtattctatcgatcaaaacctctggggacgcgccaatgagtgcggcattttagaagatccatgggcggcgccgccagaaggtgcatacgatttaacagctccgctggaaaaaacgccggacacgccggaagtgattgaaattgcatttgaacagggcgtgcctgtctccattgacggtgtttcctactcgctttctgagctgatcttgaagctgaatgaaatggcgggcgcgcacggtgtcggacgtatcgaccacgtggaaaaccgcctcgtcggcattaaatcccgggaagtatacgaatgccctggtgcgatgacactgatcaaagcgcataaagaattagaagatttgacactggtgaaagaggtagcccactttaaaccgatcatcgagcaaaaaatgtcagagatcatttacaacggcttatggttctcgccgttaaaagatgcgctgcacgctttcttaaaagaaacgcaaaagcatgtcacaggcattgtccgcgtgaagctgtttaaaggccatgcaattgtagaaggacgtaaatcagaatactctctatatgatgaaaaacttgcaacatatacaaaagacgatgcatttgatcaccatgcagcaattggatttatcgagctttggggacttccgacaaaagtgaacagcatcgtaaaaaagaaggagcagattaaagcatgaagaagctctggggaggccgatttcaaaaaacaccggaaaaatgggtcgacgagttcggcgcgtccatatcatttgaccaaaatttagttgctgaagacattacagggtctctcgcacatgctgccatgctgaaaaaatgcggtattctgacagcagaagaagagttgaaaatccgagagggcctgaatacccttttgcaaaaagcagaggagggagcattggaattctcagtcgattatgaggatattcatttgaacattgagaaaatgctcattgacgaaatcggtcctcttggcggcaagctgcataccggcagaagccggaatgaccaggtggcgactgacatgcatttatacttgaagaatcatgtcggccacatcatcgagctgattgaggcattccaaagtgcgctgattgaaaaggcggaagcgaacgttgaaacgattctgccgggctacacacatctgcagcgcgcccagccgattttattcgctcaccatatgcttgcgtatttctggatgcttgagcgcgacaaggagcgttttcaggattcaatgaagcggattaacaaatctccgctcggctgcggggcgctcgcgggaacaaccttcccaattgaccgtgattattcagcggaactgctcggctttgatgccatttatgaaaacagcttggacggcgtcagcgacagagacttcattttggagtttttaagcaacagcagtatgctgatgatgcacctatcccgtttctctgaagaaatcattttatggtgctcgcaggagtttaaattcatcgagcttgacgatacgtacgcaacaggaagcagcatgatgccgcaaaagaaaaatcctgatatggcggagctgatccgcggcaaaacaggacgcgtatacggcgatatgatggggctgtttacgatcatgaaaggacttccgctcgcttacaacaaagatctgcaggaagacaaagagggcatgtttgacacggtgaaaacggtggagggcagcctgcaaatcttcacaggcatgatccaaacaatgactgtaaacaaagacgtcatgaagcaagcaacaaaacaagacttttcaaatgcgacggaactggccgattatttagctaaaaaaggaatgccgttcagagaagcgcatgaagtggtcgggaaacttgtgtacacatgcatcgaaagagggatctatttaagcgatatgccgtttggcgagtttcagcaggcgagcacactatttgaagaagatatttacactgtgttagacccttactacgcagttgaaaaaagaatgagcgccggcggcaccggattcaaacaggtaaagcaggcgcttgaaaaagcgaaagcttgcgtggcagcaggagtttgttaaaatttccttcataaaatcccgtcattatagccaacctacctctataatgatgggaggcagaatgatgaaaaaagaaccggaacgctatatttatgatgaacaagaaagccaggagacaacaaggctcatttcagaagcgtatcaaagcggttatgtcgatatgcctgatcaggagtcttcatctcctgcagaataagctgtctgtacaggcagctttttttgtatgccaaagtgtaaaaagtgatattgcaagccttttatagtaaagtagaagaagaaacactttattgaaagcggcgacgttgctttgggaggtattcatgtgcgacatgctttaattactgccggttcgaagggtttaggccgcaaagtgactgaaacgttgcttgcaaaggggtattcagtaacagtcaattacagacaggatgaggaggcagtcagccgcctgaaggaagcctgtcccgattgtcttgaccggctgcaatttgtaaaaggtgatgtcaccaaaaaagaagatctgctgcgtattgcagaggctgccttaaaccgcttcggaaggatcgactttttgattaacaacgcgggaccatacatatttgaacgtaaaaagttagccgattatactgatgatgaatggtatggcatgctggaaggaaatttaagcgccgtctttcatttattcaaagcggttattcctattatgagaaaacagcaatttggacgcatcattacgtacggattccaaggtgcggctcacgcgcccggctggcttcaccgatctgcatttggcgctgcgaaagtgggcttggcttctttgacgaagacaattgccattgaagaagccgaattcggcataaccgccaacatggtttgcccgggagacattgtcggcgacatgaaagaagcatcgatagaggaagccagaatgcgaatcggcaaagagaaaacgccgataggaagatccggtacaggcgaggatatcgcccggattatcgctttcttgtgtgaggagaactcagaccttgtgacagggactgtcattgaagccaccggtggcctcaatgtcattaacaagaatcaaacaacataagtttttcagctttttaaaaagggaaaataaaaaaatcaaaatcatgtgacgaggtgaaagaaatgaaagtgacatatcacggacattctgtaatcacagtggaaacgaaggaccatcatattatttttgatccgtttttaacagggaattcattaacggatataaagccggaggatgtaaaagcggatgtcatcttattaacgcacggccacaatgaccatgtcggtgatactgaacaaatcgccaagcaaaataacgcgttggttatagccccgaacgagctcgctgtgtacttaggctggaaaggcttgaatgttcatccaatgcatattggcggctcccgccagttcgattttggaaaagtgaagctcacacaggcctttcatggatcagccatcacagatgaagaaaacaaaacgatcacttacacaggcatgcctgccggtattttgctgactgtagaagataaaacgattttccacgcgggcgatacggcacttttctctgatatgaaactcattggcgaattgaatcatatcgaccttgctttccttccgattggcgataactttacaatggggcctgaagacgccaagcttgctgctgaatggctgcgcgcaaaacaggtcgtgccggtgcattacaatacattcccggtcatcgaacaagacccagaagcattcgctgacagcctgccgggcggagtcggcaaagtcatgtcggtcggtgagacgatcgagctttaaaccgtgaaaccatctcctgatgaatcaggaggtggtttttattttttcagttatcctgtaatggtcttatcagaggttccttccaattctttgctgcgctgctgaaaacgtttggttatccgggcgatcaagtccttcgtggcgcggtcaaaatgaacttctttttgatttgtcaacagccctatgggcggggtgatatccaggttcagaattggaatgactttagtgccgttgaacggtttagaatgtgcggtgctggtaaagattgaaattccgatgttttcacgtacgtaatattcatgtgacatgctgcttgtgagctccatttttttgtagcgattcccgagttctctatgtaaatgctgttcaatttgtaagcgaatggggcaattggcgggcgtaaatatgaagcgctcttctgctaaatcagacaaatggacagccttcttctcagcgagcggatgttgatcagatacaatcacatttaatgtgtcataaaaaaatggatggtagtaattttcaagaatcagctccggctcgccgcagactgcaaaatcaatcgtcccgtctaagagcttttgactgcaggtattggcgtcatcaaccttgatattaaccgttatctttgggtaatccattaagaaatcctttaaaatctcggggaatatcagactggcggttggctctgaaacccctatgttgataatgcctgcctcttcttcctttaagtcggagaggttgtgtttaagcgcctcgtattgcatcaaaagatctcctgttcgttcataaaaaagcttccctgcttttgtcaactgcaggctttttcctctttcaaacagcagtacgcctaaatcctgctccaattgcttcatacgcatcgatatcgtcggctgcgagtagttgagtatttctgcagctttatagaagcttccaaattttacaatcgtatgaaacgttttgattgagcgtaactccaatgtgctccctcctgtttttcatcattaaaaatactgaagtgaaggtttactttttttgattagtcaaagatcagagtatgctttatagtataaacaataaaagcttagtaaacaaataggaattatatattttgagaagaggagtgacaaaaatgagtgaggatatttttcgactggcaactgttgaagatgcaccggagctgttgaaactggttaacagcgcatttcagcccattcggcagctggatattgattggccatccacgagagctgatatccaaatggtatcagaaaatattgaacatcattcagcgattgtgctggagcgggatgggaagctgatttcaacgattacaatcaggttcccgtgggagagtgagacgcctccttcaaaatatccgtttgtgtggtggtttgcgacactgccggaatataaagggcaaggcgccggaagtaagctgcttacgtatgttgaagaaaaagtgcttcgagatatgctgaaggctcctgcgctgacactcggcacatccgcgcgcaagcatccttggcttgctgacatgtacagaaggagagggtatgaagtgtattttgagcaggaaaaagacggggacataggtgtgatgatgcacaaggttctgattccggaacgatttaacccaacgcttttaggtgcgcccagctgggcatgatgtgaggcagcctatgaataagcgtaaaggattggttttgctgctgtcagtgtttgcattacttggcgggggatgttcgcaaacaaataacaaaacagatcgtcaggctcaaacagtcataatcggcactggaacagattttccgaatattgcgtttttaaatgaaaaaggcgatttgaccgggtatgacattgaagtgatgaaagccatcgataaggagttgcctcaatatacatttgaatttaaaacgatggatttctcaaatttgctgacgagtctcggaaataaaaaaattgatgtgattgcgcacaatatggccaaaaataaagaacgagaaaagcgttttttgtatcataaagtcccatataactactcgccgatgtacatcacggtgaaagaggataatcacaagattcatacattaaaagacttacacggaaaaacagtcatagttggcgccacgtcaaatgcggcagattatattacaaagtacaacaaaacgcacggcagcccgattcatttgaaatatgcgggacagggaagcaatgacaccgccaatcaaattgaaaccgggcgcgcagatgcaacgatagctacaccgtttgccgtcgattttcagaataaaacgcacgccttccgccaaaagacagtcggtgacgtgttattagataccgaggtgtactttatgtttaataaaggcagccaaaccttggcggatgacacggatcaagcgattaaaaagctggagaaaaacggaacgctaaaaaaactaagccgaaaatggctcggggcagattattcaaaatcaagttttgaaaaataaatggggcgatgagatgaaaacgaaagcagcattcatggcaatattattttcgcttataacagttctgtcagcttgcggtgcaggcagtcaaacgacgggagccgggcaaaagaaggtacagacgatcacggtcggaactggaacccaatttccgaatatttgctttatcgatgaaaaaggcgatttaaccggttatgatgtcgaactgatcaaagagcttgataagcgcctgccacattataaattcacatttaaaacgatggaattttccaacctgcttgtcagcctcggacagcataaagtcgatattgtggcacatcaaatggagaaaagcaaagagcgtgagaaaaaatttctgtttaacaaggttgcttacaaccattttcctttaaaaattactgtgcttcaaaataacgatacgatccgtggaattgaagacttaaaaggaaaacgggtgattacgagtgcaacctccaacggagcgcttgtactgaaaaaatggaatgaggataatggacggccgtttgagattgcctatgagggccaaggcgcaaatgagactgcgaatcagctgaaatcggggcgtgcggacgcaacgatctcaacgccttttgcagtagactttcaaaacaagacgagcgctattaaagaaaaaaccgtcggtcatgtgctttcaaatgccaaagtgtattttatgtttaacaaaaatgaacaaacgttaagtgacgatattgataaagccttacaggaaatcattgatgacggaacgctgaaaaggctcagtttgaaatggcttggtgacgactattccaaagagcagtattaggtaaaaagagagggagcagtgatggaaaaagcgtttgatatgaacatgattggagattttgtgccgacgttaaccgcttatttaccggttacattatacattttaacactgtccttgcttttcggttttgtattaggactctttctggcactgccccgcatctataatattccaattgtaaatcaattggcaaaagtgtatatctcgtttttcaggggaacgcctatcatggtgcagcttttcatcgtgttttacgggatcccggcgcttacggggcttatcgggattgatacatcaaaaatggacccgttttatgctgctgtcgcaacctacgcgttaagcaatgcagcggcagccgcagaaatcattcgagcgggggtgggcagtgtagataaaggccaaacggaagcggcgtacagtattggcttaagcggtagtcaggccttcaggcgaatcgttctgccccaggcacttgtccaggcgtttccgaatatgggaaacatggtgatcagttctttaaaagatacgtctctagccttttcaataggtgttatggatatgtccggaaggggccaaacactgattacctcaagcaaccattctcttgaagtttacattgcgctatcgattgtttattatgctgtagcggttttattcgaatggttctttcgagtggcagaaaaacgaatcaagaagaatcaaacaaggattgttactgtttttgacatgaacatacattgatatatttcttcggatgaggggggagaagattgcaatttgactttccatttatcgtttccgccatgaaagaaatggtaaagaccattcctctgacattgatgatggctgttttgccgattgtgtttggatttctcgtggctcttggaaatataattgttagaatttttagaattaagggcttggtggcttgctcaaggttttatgtgtctttctttcgaagtacacctgcaattcttcacattatgttgatttatttagggataccgcctgttgcagatcaagtcagcagtttttttcatctcggctggtccgccaatgagataccggtctccatgtttgtcattatggccttgtctttaactgccggagcttatctgacagaaatcatccggtcgggcattctggcgatggataccggacaggtcgaagcggcttattcaatcggcttgacacacagccaaacatttcggcgtgtaatattgccgcaggcgctgatggtttccatcccaaacttcacaaatttgggtatcggctttttgcataccacctctatcgcggctatagtggctgtcccagagattacagggacggcgactatcgttgcttctgataattatgcatttttagaagcgtttatcggagcagcgattatctattgggtgctgactctaatcctagaatccgtaaatggagtattagagagaaaggcagccagatttcaaggaggcactttatgattgagattaaaaatatccataaacagtttggcatccaccatgtattaaaagggataaatctcacggtacgcaagggagaagttgtgacgattatcgggccgagcggatcagggaaaaccacctttttacggtgcctgaatttattagaacgtccagacgaagggatcatttctatacatgacaaagtgattaattgcagctttccgtcgaaaaaagaggttcactggctcagaaaacagacggcaatggtatttcagcaataccacctgtttgctcacaaaacggtaattgaaaatgtcatggagggcttgacgattgcccggaaaatgagaaagcaagacgcgtatgccgtagcggaaaatgaactgagaaaggtcgggcttcaagataaattgaacgcttatccgagtcagttatcgggaggacaaaagcagagggttgggatagcaagggcgcttgccattcatcctgatgtgctgctgttcgatgagccgacggcagcgcttgacccggagctggtcggtgaagtgcttgaggtaatgctgggaatcgtgaaaaccggagccaccatgattgttgttacacatgaaatggagtttgcaagaagggtctctgatcaagttgtttttatggatgaaggagtcattgttgaacaaggaaccccggaggaagtcttccgccataccaaaaaagacagaacgaggcagtttctccgccgtgtttcgccggaatatttatttgaaccaaaagaacacataaaggagccggtgatatgatccgcttaagtattttagaccaaagcttgattggtgaaggggagacagcagctgatacattacagcatacagtgaacttggcacaaatggctgaagagtgtggatatcaccgattttgggtggccgaacatcacaacaatgatgagattgcagggtctgcacccgaggttcttttaggctatcttgctgcaagcacaagaaaaattcgtttagcatcaggcggagtgatgctgcagcattacagctcttataaagtagcggagcaattccatcttctatcagcgttagctcccggccgtatagatcttggagtgggcaaagcgcccggcgggtttcagctgtccacagacgcgctgcaggccgaatataaaaaaccggtgcgtcagtttgatgaaaaactggaggagcttactcatttcgttcgggatgattttcctgatacccaccgctatgccgcattgcgtcctaggccgcaggttgatcggaagccgggtatttttctattgggaggaagcgcagagagtgccatttcggctgcaaaactgggaatctcttttgtctttgcttactttattaacggtgaagaggaagtgctgaaggaagcccgccgagcatttgacgcgcatctcccgccaggatctgaggctgaatttcatcttgcccccgctgtttttgcggcacatacaaaagaagaagcggaaaaacatattgtgtcgcgtgaatcgataaaagtggttttgaaagacgggcgtaaggtcaacgtcggttcccgcgaacaggctgaggcctatctggaaaacgtcacagagccctatgacatcatcgtgcaaaaaaccgggattattgccggaacaaaggaagaagtggcagaagaattaacacgtttatcaggcacatacaaaatcaatgattttgttatttttacgccgatcaaaaatgctgtagaaaaacagctgtcttatcagctgctgagcgatgcagttttagctgcaaaacgttaaggagggacagaagaatgagtgatgttgtgaacattgtggtttggagtaaaaaaggctgttcgtattgtgaggaagtcaagaattatttgaatgaaaaagggttcccgttccaaaatatcgatgtttcagagaaagaaaagcttcgggatattttacaggtgaaatatggggtgcgccatgtgcctgtggtcgaaatcgggcgcggcaatcagtatcaagggataactgaaatcggcattgaacaccttgatcttgcacttgctaatcatgcacagataaaggaggcaaaaagatgacacgttcagattttattcagtttggagccatgattcacggtgtcgggggaacaactgacggctggcgtcatcccgatgttgatccctcggccagcacgaatattgaattttacatgaaaaaggcgcaaacagctgaaaaaggtttgtttagttttattttcattgcagacggcttatttatttctgaaaaatcgattcctcattttttaaaccgttttgaaccgatcaccattttatctgcgctggcatcggttaccaaaaatattggtttagtagggacgttctctacatcttttactgagccattcactatctccagacaattgatgtcgctggaccatatcagcgggggcagggcaggctggaatcttgttacttctccgcaggaaggagcggcgcgcaaccatagtaagtctaatttgccagaacatactgaacgttacgagattgcacaggagcatttggatgttgtgcgcgggctgtggaattcctgggagcatgacgcatttatacacaataagaaaacagggcagtttttcgatccggcgaagcttcatcgcctgaatcataaaggaaagtattttcaagtagagggacccttgaatatcgggcgctctaagcagggagagcctgtagtgtttcaagcgggttcatcagaaacaggccggcagtttgctgctaaaaatgcggatgcgatttttacccattccaattcattagaagagacaaaagcgttttatgcggatgtgaaaaggcgagctgctgatgaagggcgtgatccttcaagtgtgcggatttttccagggatcagcccgattgtggcagatacggaagaagaggcggaaaagaagtatcgtgaatttgcagaattgataccgattgaaaatgctgttacttatttggctcgtttttttgatgattatgatctgagtgtttacccgttggatgagccatttcccgatattggcgatgtgggaaagaatgcgtttcaaagcacaacagaccggattaagagagaagcaaaagccagaaatctgacattgcgggaggtagcacaggaaatggcttttccacggactctattcatcggaacaccagagcgtgtcgcatccttaattgaaacttggttcaacgctgaggcggcggatgggtttatcattgggtcggatataccgggaacacttgatgcttttgtagaaaaggtgattccgattcttcaagaaagagggctttatcgtcaagattatcgcggcgggacattgcgggaaaatctcagtcttggcattccgcagcatcaatccgttttacattcatcacatcattaggtttcgtctgatcgaatgcggaagctgagagaggaggctgacttttttgacgatcattgccggtacggttgtgaaaggaaaacaattaggcagaaagcttggattccccacggcaaatgtagatgcaaaaatgcatgggctgcgtaatggagtttatggggttctggcgacagtcaatcatcaatttcatttaggggttatgaatatcggtgtgaaaccgacggtgggctctaaccttgaaaagacattggagatttttttgtttgactttcatagagacatttatggagaaaaaatcgaatgcagcattctctttaaaattagagaagaaagaaggtttgattctttggagtcgttaacaaagcaaattaaaaaggatatttcgtgcgctgcaaaacgctttgagctgattgggattatggcaccgaacaaaaaagaaagcctgctttcccatcaggagttaaatcttccggatctctgcttttacaagaaatgtaacaacctatatggagtcaaccgaggcgtatacaatgtcattgataactggttttttgagtacggaattacacaagtagcttacaggcgcatttatattttatcttttttaagctttttgaaagaggataatccgaaagtttccagcaagtatataagatttggggcgggtggtcttgctgataaattgaaccgatttatttcatcttatgttgaagagtctgaagaaaatatattgggatagggaaaggagcggaacatatgtctttggattattggagaaatatagaaggctcctatccatatcagactacaggaaatgacatcctgaagttgaaaggggagtctaatcccgtaaatctctcaacgctagaaaagcagctcatcggcattcgccggcacctgcaccaatatcctgaactgtcaaaagaagaatttgaaacaactgcttttataaaaaaatgccttaaagaaaaggggatacagattcgccctactgctctaaaaacgggtgtgttcgcagacatagcaggggagtcagaaggtccggcgattgctttgagggctgatattgacgccttgccaattgaagaaaaaacaggattgccttatgcgtctaaacataaagggatcatgcatgcatgcggtcatgattttcatacggcagcgcttcttggtgcggcctttttattgaaggaaaatcaagacagtctgaaaggaaagattcgtttattatttcagccggcagaggaagcgggtgcaggcgctgcaaaagtgatagaggacggccaactggatggcattgatgcggttattggccttcacaataaaccggatatcgcggttgggactgtagggttaaaaacaggcccgcttatggctgctgttgaccgatttaaagtaaagatagaagggaaaggcgctcatgcagcattgccgcataatggttttgatccaattgtcggcgcctctcagcttattgtcgccctgcaaacgattgtaagcagaaatgtaaacccgctgcaaagcgcgattttaaccgtagggaaaatcaacggcggcagcacttggaatgtcattccggatacagttgtcattgagggcactgttcgtacatttgattcagaggttcgtgatcaagtgaaacagcgttttttggcagtcgcagagcagatttctgccgcattctcgttaaaggcaaatgtgaagtggcattccggaccgccgccgctttgtaatgatgaggcaattacggggctggtgcgagacgctgcgcataaagcgaaacttcaagtcattgatcccgccccatcaaccgcgggggaagattttgcttattatcttgagcatattccgggatcctttgcgttttttggaacagacggtgatcatgattggcaccaccctgcatttacaattgatgaaactgccattatcaaagcctcttattttttatatgaaagcgccaagagattgttagattcgaatgaagagtcaaaaatatctgattgatatagatggggtgttctgatgaagaaattaatcgtttttgcatttattggtttattgtcgcagttaatagacggttcgttaggtatggcttatggggttacctcaacttctttgttattggcgtttggcatcacacctgctgtggcttcggcttctgtccatttagcggaagtcgtaacgactgccgcatcgggagtgtcgcatattaaatttggcaatgttgacaaacaaaccgtttatcagcttgtcattcccggctctataggcgcttttttaggcgcggcattcctcagccaattacctggagatgtggcgaaaccctatatttctttgtttttgctccttctgggcggatatgtattgatcaggtttttatttcaatataagccggctcttgagaagaagcatgtgccgttaaaccgaaaacaatccatcccattgggagtgatcgctggttttgcagatgccacaggcggaggcggctggggaccggtgaccactccgattttattatcccgcaaaggcttgagcccgaggaaagttgtcgggactgtagacacaagtgaatttgccatcgccgtatctgcaaccgccggttttcttatttcattaggatgggaggacgtcaattggttatgggtgttttcactaatggccggcggaattatcgctgcccctatcgcagcatggctggtgcagaagtttcatccgcaattgatgggtgtgcttgtaggaggatttattattctggtaaatgccagaacattaataaatgaatggatcgcaaatacagctgttcatccattgatctatacggccataggggcgatatggctatccgcagttttatttgttttatctaaaatagggaatcgaaatattgttaagacagcgattgatgtccatttaaaagaaaaataaagggtttttccgctttacgatgtaaaaggaatcacgtggtccttgcgcttgactggaacgaaatcaacgctgtaagaagccggtcgggcttcttttttattttccagcctcattgcgtataaatcctttgaaaccttataataaaaacaagaagactgtccttagaggtgaaaggcttggcaacgaagcatgaacaaattttaacgtatatcgattcactgcctgtcggtgaaaaaatttctgtccgaagaattgcaaaggaaatgaaagtaagcgaaggaaccgcgtacagagcgatcaaggaagcagagaataaagggtttgtcagcacaattgaacgtgtgggcacaatcagaattgaacaaaagaaaaaagagaacattgaaaagcttacctatgcagaggttgtaaatgttatagacggacaagtgctcggaggcagggcagggctccataagacattgaataaattcgtcatcggcgcgatggagcttgacgcgatgatgcgttacaccgcagcggggaatcttttgattgtcggaaacagaatcaatgcacacaggcaggcgcttgaagcgggtgcggccgtattggtgaccgggggctttaacacggatgacagcattgtgcagctggcagatgagcttgaactgccgattttatccacgagctatgacacctttacagttgccgcgatgattaaccgggcaatatatgaccagctgatcaaaaaagaaattgttttggtggaggacatcctaacacctgctgaccgcacggtatatctttcgcctaaggataaacttgaaaaatggtatgagaaaaattttgaaacggggcacggccgcttcccggttgtcgacgatcaaatgaaaatccatggcattctgacatcaaaagatattgctggccatgaccgaaatgcatctatagaaaaagttatgaccaaaaatcccgtcacggttattgggaaaacatctgtcgcttcagctgcgcaaatgatggtatgggaagggatcgaagtgcttcccgtcactgacggccaccaaaaactcatcggcatgatcagccgccaagacgtattgaaagctcttcaaatgattcaaaagcagccgcaggtcggggagaagcttgatgatatcgtttcaagggggtttaaagatgagggtgatgataaagaagatcaaacggtttacgagtatgaagtcacgccgcaaatgacaaatcagcttggaaccatttcttatggcgtatttacgaccattttgacgcaagcggcaaaccgatttttgcgctcgaaaaaacgcggcgaactcgtcatagagagcatcaccatcttctttttgaagcctgtgcagatggaatcagtcatcgaagtcaaacctcgcatcttggaggccggcagaaagtttgggaaaatggaagtggaagtgcacagccaaggtcatatcgtgtctaaagcgatgctgatggttcagctgatggaaagaagctaagggacgttcaggcgccccttacgcgtgatctctttcagcttctttggcgtgaaggggattgtaatgcctgaaggctttataacctgcccaagcgcttcctgctcctatgacgataaagataccgccgattactaacgttaatactgaatggaataatatcatttggttgagcccgtagaacaggactagtgaccctaaggccatgcttgattttgctgaacatatttcttttgccaaagatggctttgcccgtacgccttttactttatagtacacataaaagcaggctgaaagcccaatcaaaaaaacaagaaccagcataaatgaaatcctccatcgtaaaagtttacaaacccattttatacaaaaacgggcttggttttgacgttatttttcttttccgtcggcagagaatgtgatttaatgaataaaaacaataaaggagtatcaaatgaaaacagaattgatcagaaccatatcattatatgacacgattatcttacatagacatgtgcgtcctgatccggatgcctacggatcacagtgcgggcttacggaaatcctgcgtgaaacatatcctgaaaaaaatatttttgcggtcggcacgcctgaaccgtccctctctttcttatattcccttgatgaggtggacaatgaaacatatgaaggcgcacttgtcattgtctgcgatacggcaaatcaggaaagaatagacgatcagcgttatccttcaggcgccaaactaatgaaaatcgaccaccatccgaacgaagatccatacggtgaccttctctgggtcgatacaagcgccagctcagtaagtgaaatgatttacgagctgtatttagaaggaaaagagcacggctggaagctgaatacgaaagcggcagagctgatctacgccggcattgttggagataccggacgctttttatttccgaataccacggaaaaaacattaaaatatgcaggcgagctcattcagtatccattctcttcctcagagttatttaatcaattgtatgaaacaaaactgaatgtggtgaagcttaacggctttatctttcaaaatgtgtctttgtccgaaaacggtgctgcttctgttttcatcaaaaaagatacgcttgaaaaattcggcacaacggcttctgaagcgtcgcagcttgtcgggacgcttggcaatatctcaggtattcgcgcctgggtgtttttcgtagaagaagacgatcaaatcagagtcagattccgttcgaaggggcctgtcattaacggacttgcccggaaatataacggcggagggcatccgttagcttcaggcgcctctatttacagctgggatgaagctgatcggattttagctgatctggaaacattatgtaaagaacacgagtagaggggagaccctctctcttagtgttcatctgtgacggggatgaaccagcagccgaaatcagtaaggtcctcgtagacttggagattgtgtgattgaagttcttttttgatgagggaagcgagtgagtttgtttcggcatatgcagaaaaaccttgtctgagacgggctgcttgatcttttgctaactgacggtcactgtaaacctccatttcccttcctccttcctttcgccattaagcctcacatatagtttataaaaaagaatgggaaaaagcgacagaagtttggagaatttaaaaaaaatccataattatgtggcgaaagatatttcaagttccactgtcagcctcgtataaataatcaattctctgacggttgcctcgtattttttttcattgatcatatagactttattttcaattgtccgcttcaagagatcctttgtttgatagacgctctctatgtcttttgtaatcacctctgaaatatcatcctttacatgctcctcgaatttcgttttatccggctgtgatattttatatttatccccattcagcaatttgacgctgacgctttgaatcagcagttttcttttattatcttcattcagtttatggaggtcttcctgatagatcgaaatttgattgttcaagtcttttacatgctctttttgcttttcgatgaggctgacctgctcctcttggaatgttccgtaagtaaacaggaaaaagaaccagctaattacggctccgcacatcattcccgcgaaaaaacgctgccatcccggttttttgtaatgctgggggaccctcatgaagaaagatgctcctgggtcagccatgatataataagccagccgctttgcgcgcctcccatggccgaaataattaaaagaagctgtttaaagatatctctcgtattgccttcgagtatgccgcgttcaaagctgtataccgcatcaaaggtgcctccgatagctgcgacaagcgcccatatttttaaccggttggcaagctttgttatggctgtaagcgggggttcgcctgccaaatatgctccgagccctccaatgagtgcgcccccgatcagcacccctaacgcaataaagtagctattgataaaattcaccataaatcctgcttcctgatccatctttatcacctcaccttttatatcatattgagctttcaggacaagtatgatgatgagtcaaaaaagaacatttgtttcttttggaaaccggccttataatgagggaagaaatgaatcgtaatgagaaagaggtgatagcatgtcttttgttcacctgcaagtgcatagcgggtatagcctgctaaacagcgccgcggctgtggaagagctcgtcagtgaagctgacaggctcggatatgcgtctttggcgctgacagatgatcatgtcatgtacggagctattcaattttataaagcttgcaaggcgagagggatcaacccaataatcggtttgacggcttctgtttttacagatgacagcgaacttgaagcatacccgctcgtcctgctggcaaaatcaaatacaggctatcaaaacctgctgaaaatcagcagcgttctgcaatctaaatcaaaaggcggactgaagccgaaatggcttcacagttatcgagaagggattatcgcaataacgcccggcgaaaaaggatatattgaaacgcttcttgaaggagggctgttcgaacaggctgctcaagcctcgctggaatttcagtctatattcggaaagggagctttttatttctcctatcagccttttaaagggaatcaagtcttgtctgagcagattctaaagctatcagaagaaacgggtatccctgttacggccacaggcgatgtgcattacataaggaaggaagataaggctgcctaccgttgtttgaaagcgattaaagcgggggaaaaactgacggatgcacccgctgaagatttgcctgatctcgatttgaaaccactcgaagaaatgcaaaacatttatcaagagcatcccgaggcactgcaagcttctgtagagatcgcggaacaatgccgggttgacgtcagtctcgggcagacccgtctaccgtcttttccgaccccagacggaacgtccgctgatgattatttaacggatatctgtatggagggactccgcagccgtttcggcaagcctgatgaacgataccttcgccgtcttcaatatgagcttgatgttatcaagcggatgaagttcagcgattactttctgatcgtgtgggattttatgaagcacgcccatgaaaaagggattgttacaggaccgggaaggggttctgcggcaggttctcttgtggcatatgtgctgtatatcacagatgttgacccgattaagcatcaccttctatttgaaagatttttaaatcccgaacgcgtcagcatgccggatattgatattgactttcccgatactagaagggatgaagtcattcaatatgttcagcagaaatacggtgcgatgcacgtcgcacagattatcacctttggaacacttgcggcaaaggcggcgctccgggacgtcggcagagtattcggcgtcagcccgaaggaggcagatcagcttgcaaaactcattccttcaagaccgggaatgacgctggatgaagcgagacagcagtcaccgcagctggataagcggcttcgggagtcaagcctgcttcagcaagtctattcaattgcacggaaaatagaaggactgccaaggcatgcatcaacccacgcagcgggcgttgtcctgagtgaagaaccgttaacagatgttgttccgcttcaagaagggcatgaagggatctatttaacgcaatacgcgatggaccatcttgaagacttgggccttttaaaaatggatttcttaggtttgaggaatctgacacttattgaatccatcacttcaatgattgaaaaagaagaaaatattaaaatagatctttcaagtatttcctacagcgatgacaaaacgttctccttgctgtcaaaaggggatacgacaggcattttccagcttgaatctgcagggatgagaagcgtcttgaaacggctgaaaccttcgggcctagaagatattgtggcggtcaatgcactgtaccggccgggtccgatggaaaatattccgttatttatcgaccgtaaacacggccgggagcctgttcactatcctcatgaagatttaaggagcattttggaagatacatatggcgtcattgtgtatcaggaacaaattatgatgattgcttcccgtatggcggggttttctttaggcgaagcggacctattgagaagggcggtcagcaaaaagaaaaaagaaatcctggacagagagcgaagccattttgttgaagggtgcttaaaaaaggagtattctgtagacactgcaaatgaggtctacgatttaatcgtcaaattcgcaaactatggctttaacagaagccatgcggtggcatacagcatgatcgggtgccagcttgcgtatttgaaagctcattatccgttatattttatgtgcggattgctgacaagcgtcattggcaatgaggataaaatctctcaatatctttacgaagcaaaggggagcgggattcgtatccttcctccgtcagtgaataaaagcagttttccgtttacagttgaaaacggatctgtcagatacagcctccgcgcaataaaaagtgtaggcgtctcagcagtcaaagatatatataaagcaagaaaagagaaaccatttgaagatcttttcgatttctgctttcgcgtgccgtcaaaaagcgtaaatcgcaaagtgcttgaagcacttatcttttctggtgcgatggacgaattcggccaaaaccgggccacgctgctcgcatccattgatgttgctttggaacatgctgagctattcgccgcggacgatgaccaaatgggattgtttttagatgaatcgttttcaattaagccgaagtatgtggagacggaggagcttcctctggtggatttacttgcgtttgaaaaggaaacgcttggcatttatttttcaaatcatcctctctccgccttccgaaaacagctcactgcgcaaggagcagtctccattctgcaggctcagcgggcagtcaaaaggcagctttcactaggcgttctgctgtcgaagatcaaaacgattcggacgaaaacaggtcaaaacatggcgtttttaacgctcagtgatgaaaccggcgagatggaagccgtagtcttccctgaacaattcagacagctttctcccgttttaagagaaggcgctctgttgttcactgcggggaaatgtgaagttagacaagataagatccaattcatcatgtcccgggcagaattattagaaaatatggatgcagaaaaagcgccatcggtttatataaaaatagaaagcagtcagcacagccaggagatcctggcaaagattaagcgcattttgctggagcataaaggggaaacaggcgtttatctctattatgaaaggcaaaaacagacgattaagctacctgagtcgttccatatcaatgcagatcaccaggtgttatatcgcttaaaagagctgttgggtcaaaaaaacgtcgttttaaaacagtggtaacgattcgctttttgttatacaattggagcaattatgtgatcctgtttaaatattcagatagatttactccgcagaatgcagcaatcaacgcagcagtatacgaatcaaaaaatatccataaggagtgtttaggagaatgtcattaagagaagaagcattacacctgcataaagtcaaccaggggaaactggagtctaaatcaaaagtagaggtcagaaatgcgaaagatctaagcctcgcgtattctccgggtgttgcagaaccgtgtaaggatattcatgaagacattaacaaagtatatgattatacaatgaaggggaacatggtagcagttgtaactgacggtacagctgtacttggccttggaaacatcggccctgaagcggcgcttcctgttatggaagggaaagcagttcttttcaaaagctttgcgggcgtagatgcgttcccgattgctttaaacacaaacgatgttgataaaatcgttgaaactgtaaaattgctggaaccgacatttggcggcgtcaaccttgaagatattgcagcgccaaactgctttatcattgaagagcgcctcaaaaaagaaacaaacatcccggttttccatgatgatcagcacggtactgccattgtaaccgtagcaggtcttgtgaacgcgctgaaactgtctggaaaatccatgtcatccattaaagttgtcgcaaacggcgcgggtgcggctggcattgcgattatcaagcttcttcatcattatggcgttcgcgacattgtgatgtgcgattccaaaggggccatttatgaagggcgcccgaacggcatgaacgatgtcaaaaatgaagtggcgaagttcacaaaccaagatcgcaaagacggttctctgaaagatgtcatcgttgatgctgacgtatttatcggtgtctctgtagcaggcgcgttaacaaaagaaatggttcaaagcatggcaaaagatccaattatctttgcaatggcaaatccaaatccggaaatcatgccggaagatgcgcgtgaagccggcgcaagcgttatcggaactggccgttctgacttcccgaaccaagtaaacaatgttcttgcattccctggtattttccgcggagcgcttgatgtgcgtgccactcatattaacgaggaaatgaaaatcgcagcggttgaagccattgcttcactggtttcagaagatgagcttagcgcagactatgtcatccctgcaccgtttgataaacgtgttgcgcctgctgttgcgaaggctgtggcaaaagctgcgatggaaacaggtgttgcaagaatcactgttgaccctgaggaagtcgcagaaaaaacaagaaaacttacgattattggtgaataattttaattcattccaaaaatggcagcgcgttggcggagaccggcgcgctgttctcaagttaaactgacggctgaaatttttttagggggttagccttaaaaaaatttcagccgggtttaacattatttttgaatgcgctgtcaaccttgacgtttcaacaccttatctgatttcatacaagcctttccgagcacgtcatcgaataaaaagttgtcgaattgaggatgacagcgtttgacaaaaaaagtacaatagtttcggtaaagttattagcaagtctatctgtttgatgacatgcggtgaagagaacccttcacaaaagggaggtaatcatttgttaaaggatatattcacgaaaaagaaaaagtatgcttccgtaccatctgatcaagcgaagcacgatgttccggaaggcattatgacaaaatgtcctaagtgtaaaaaaatcatgctcactaaagagttggataaaaatatgcgggtatgcatgaactgcgattatcatttcccaatgaacgcaaaacagcgtatcgaaagcttgatggatgaaaaatcctttgaggaattcaatcagggaatgctctcggaaaatccgcttggtttcccgggatatctggaaaagcttgaaaaagatcgcgagaaaacatccttaaacgaggctgttgtgacaggcaagggcaccatcggcggacacccggctgtagtcgccgtcatggactcttcattcagaatgggcagcatgggttcagtcgtcggtgaaaaaatcacgcttgcgattgaaaaagcaaaagctgataaagttccgtttattatttttacggcttcaggcggcgctagaatgcaggaaggcgtattaagtttgatgcagatggctaagacaagctctgcgttaaaactgttcagtgaagaacagggtcttattatttcagtaatgacgcatccgactaccgggggcgtatcagcaagctttgcatcccttggcgattacaatttcgctgagcctggcgcgctgatcggttttgctggaagacggattattgaacagacaataggagaaaaactgcctgaggacttccaaacggctgagtttttattaaaacatggacagcttgatgcggttattcatcgcgacgatatgaaaaaaacgttagaaaatctgctggatatgcatcaaacaggaggtgacattgagtggctccaagattagaatttgaaaaaccggtgattgaactgcaaaccaaaatcgccgaactaaaaaaattcacccaagattccgatatggatctaagtgcggaaatcgaacggctcgaagaccgtctcgctaagcttcaggatgatatttacaaaaatttgaagccgtgggaccgggttcaaatcgcgcgtctggcggaccgtccgacaactcttgattatatcgaacacctgtttaccgacttttttgaatgtcacggagacagagcgtacggggacgatgaagccattgtcggcgggattgcgaagttccacggcctccctgtaacggtaatcgggcatcagcgcggcaaagacacgaaggaaaacctagtccgcaattttgggatgccgcatccagaaggctacagaaaagcgcttcgtctgatgaaacaggctgacaaatttaacagaccaattatctgttttattgatacgaagggggcataccctggacgagcagctgaagaaagaggacaaagtgaagctattgccaaaaacctgtttgagatggccggccttcgagtgcctgttatctgcatcgtcattggtgaaggcggaagcggcggagcccttggtctgggtgtaggcaatcacttgcatatgctggaaaactctacttattctgttatttctccggaaggtgccgcggcacttttatggaaggactccagtcttgctaaaaaagcagcagaaacaatgaaaatcactgcgccggatttaaaagaattaggtattatagatcatatgattaaagaagtaaaaggcggagcgcaccatgatgtgaagctgcaggcaagctatatggacgaaacccttaaacaatcgttaaaaactttgctgaagctgagcgaagaagaattagttcagcagcgttatgaaaaatataaagcaattggcaaagtctcggttgaagatcaatatatcggggtaaactaaataaacgtgaagcctttggctcacgtttattttttgtgacattccttaaattttatttaaaaacaatttatttaattgtataataggtaaggtttcatagggaggatggagatcccttttcattgtttttagggcaatgatcatgttatgtttaatcatatatgttgctgaggtgaatggagaatgaaacgaataggggtattaacgagcggcggggattccccgggaatgaacgcagcagttcgcgcagtagtcagaaaagcgatctatcatgacgttgaagtttacggtatttacaacggatacgcgggattgatcagcggaaagattgaaaagcttgaactcggatcagtaggcgatattatacatcgtggagggactaagctttatacggcgagatgtcctgaattcaaaacagttgaaggccgtgaaaaagggatagcaaacttgaagaagcttggtattgaaggccttgttgttatcggcggagacggttcctatatgggtgcgaaaaaattaacggaacacgggtttccatgtgtaggtgtaccgggtacaattgataatgacattccgggcactgattttacaatcggtttcgatacagctttaaatacagtaattgacgcaattgataagattcgtgatacagcgacttctcatgaacgtacatatgtaatcgaagtaatgggccgtcatgccggcgatatcgcattgtgggccggtcttgcagggggcgcagaatcgatcttaatccctgaggcagactatgacatgcacgaaatcattgcccgcttaaaacgcggccacgaacgcggcaagaagcacagtattattattgttgccgaaggtgtaggcagcggtgttgaattcgggaaacgcattgaagaagaaacaaatcttgaaactagggtatctgtattgggccatatccagcgcggaggttctccgagtgctgctgaccgtgtgttggcaagccgtctcggcgcatatgcagttgaactgctgcttgaaggaaaaggcggacgctgtgtaggtatacaaaacaataagcttgtagaccatgatattatagaaatacttgagacaaaacacacagttgagcaaaacatgtatcagctttcaaaagaactgtctatctaatgtacagctgaaggctgaagatttcagaaggaagtgaaccaaatgagaaaaactaaaattgtttgtaccatcggtccggcaagtgaaagtattgaaatgcttacgaaattaatggagtcaggaatgaacgtggctcgattaaacttttctcacggagattttgaggagcacggtgcaagaattaaaaatatccgcgaagcaagtaaaaaacttggcaagaacgttggaattctgcttgatacaaaaggtcctgaaatccgcacacatacaatggaaaacggcggtattgagcttgaaacaggcaaagagctcattatttcaatggacgaggttgtaggaacaacagataaaatttcagtgacatatgaaggtttagtccatgacgttgaacaaggttcaacgattctgttagatgacggccttatcggtcttgaggtacttgatgtagatgccgctaaacgcgaaatcaaaacaaaagtattaaacaacggaacactcaaaaataaaaaaggtgttaacgtaccgggcgtaagtgtcaatcttccgggtattactgaaaaggatgcgcgagacatcgttttcggtattgagcaaggagtagacttcatcgcaccatctttcattcgacgttccacggatgtgctcgaaatccgtgagcttcttgaagagcacaacgctcaggatattcaaatcatccctaaaatcgaaaaccaagagggcgtcgacaacatcgatgcgattctcgaagtgtctgacggcttaatggttgcacgcggagacttaggtgtggaaattccagctgaagaagtgccgcttgtgcaaaaagaactgatcaaaaaatgcaacgcgctgggcaaacctgttattacagcaacacaaatgcttgacagcatgcagcgcaacccgcgtccgactcgtgcggaagcaagtgacgttgcaaacgcgatcttcgacggaacagatgcgatcatgctttctggtgaaactgctgccggaagttatccggttgaagcagttcaaacaatgcataacatcgcgtcccgttctgaagaagctttaaattataaagaaattctctcaaaacgcagagatcaagtgggcatgacaattacagacgcaattggacaatctgtcgctcatacggcgattaacctgaatgctgctgcgatcgtaacgccgacagaaagcggccatacagcacgtatgattgcaaaataccgtccgcaggctccgattgttgcggttactgtaaatgactctatttccagaaagcttgccctcgtatctggtgtattcgcggaaagcggccaaaatgcgagctcaacagatgagatgcttgaggatgctgtccaaaaatcattgaacagcggaattgtaaaacacggcgatcttatcgttattacagcaggcactgtcggtgagtccggcactacgaacttaatgaaggttcatactgtcggcgatatcgtcgctaaaggccaaggcattggacgcaaatcagcttacggtccggttgtcgttgcacaaaatgcaaaagaagctgagcaaaaaatgactgacggtgcggtacttgttaccaaaagcactgaccgtgatatgattgcatcccttgaaaaagcgtctgctcttattacagaagaaggcggtttgactagccatgcggcggtagtcggattaagccttggcatcccggttatcgtgggtctggaaaatgcgacatctattttgacagatggccaggatattacagttgacgcttccagaggcgcagtctatcaaggccgtgcgagcgttctttaattacaggtgaaaatggaaggggaatcccttccttttctctttatcatgccttttgttgaacagaacgtgttacacgtgtggggggcttggatatgagatttttgtttttgctttttattgtgtttccggcaatagaaatcggcatattcctatttttaggcaagctgattggcattttaccgacagttctattcatgattctgactggcattatcggcgcagcagctgcaaaaaaacaaggaaccgaagtgtattataaggttcagcgtgatcttcaatatggcaaaatgccgggagaagcgattgctgacggtctgtgcattttcattggcggtctattgctgatgcttccgggctttttatcagatttggccggcgcctgtcttcttatcccgtttacccgcggctggtgtaagccgattctgttcaaatggctgagaggaatgtcgaagaataagcggatcatcatcaaataaaaaacggcagccatgaaaaaacggctgccgttttatttttgctgaacggtgatataggaccatatttcttttaatgcgcctgttgtgatgaaagcttggatgatgacgagtacagccggtcccgcaatcagtcctaaaaacccgaataatttaaagccggcaaacagggcgatgagtgttgccagcggatcgatcccgatagatttacttagtatcttgggctctgtcagctgccgctgaataagaacgacgaggtacaggataccaattccgattgcttggggcagctggcccgtaatcgataaatacaaaatccagggcacaaatacggagccggcacctaagtaagggagaagatctacaagcccgattaaaaaagcaattgttgcggcgtgttcaacctttaagagagaaaggccgataaatacaatcaccatcgtgatgaaaacgaggacggcttgtgctttgataaaaccagtcattgctttttttaattcgctgctgattgctttgctgttagctgtcacacgatccggcagaattaaaacaagcatggctttcagcttatgccaatcctttgtcataaaaaaggttgccagaagagaaaaaatcagaaccgccgccgtattgggaagaagagcgaaaaatctcgggatcatctctagaatgtgggacagcaggagcccggcatttttagcggcagaatcaccgagtgtctggatatgagtgacgatggaagcctgttggttcgtttccaattcttgaaacaaaagagttaactcgttatagagcggctgaatatgagttgtaaacaatttttcgcaatatgaaataaacgtgctgatatgcggaggcagcgtttttgctagataggctgttcccgttacgatttcggctaccagaatggtgaggacgccgaaggctgcgagcagaaaaaaagcaagaacgcccagaacatttatcgttcgggggaatcctgtcactttgtccaaataatcgacaacaggatgaatcactgaagaaagaataagggcgatcaggaacggataagttaacggaaacgaataataggccgcagctatcgaccctgcggtcattgatatgacaaagagggttctgaaaaaaatagtgatataagattgattcacgaaaacggtcctcctctcgtcagcatgtcctattttttatatgtattcacgctgcggctgaatatgaatacattcatcttaaaggagggatggcatgtgtttacacaagcgaatttatttttaattttactcttggctatcgcacttatcgcaaaaaaccaatcattgctctttgctgtatccgtccttttgatcatcaaaatcgttgggcttgatcagaaattatttccgaccatccagtcaaaaggcattaactggggtgtgaccattattaccatcgccgttcttgtcccgattgccacgggagaaatcggatttaagcagcttggagaagcaatgcggtcttcctacgcatggatcgcccttggagcggggatcgcagtggcgctgattgcaaaaaacggcctggccctgcttgaaaatgatccgcatattacaactgctctcgtgatcgggaccattcttgcagtcgcgctttttggaggagttgcggtgggaccgttgatcggagctgggattgcttatttagccatgcagatcgtaaaactgttcacttcataaaaaaagcggccttaaagccgctttttttgtatgcaaaaacccgcaaataaaggcgttttttcggggaaatcacagaatgaaaaaaaaaattataggtaaacatttaacaaatgtctgattattgtttataatgagaataggcttaaacttaaataagcttataagaatttgttatgttctttcataagcaaagggttttagttccagcagccagtaaaatgtaagcattttctttttgggggagagaaatacttgcatcgtgctttttaagtaagcctcatgtttttacaacactcttaaaggggaaatttattgaaaaggagatgttatatatgacagcgacacgcggtcttgaaggggttgtagcaacaacatcatctgttagttctattattgatgatacccttacatatgtggggtatgatatcgatgatttgacagagaatgcaagttttgaagaaatcatctacttgctttggcatctaaggctgccaaacaaaaaagagcttgaagagttaaagcagcagcttgcaaaggaagctgccgttccgcaagaaattattgagcacttcaaatcttattccctcgaaaatgttcatcccatggctgctcttcggacagcaatttcattactaggcctgcttgacagcgaggctgataccatgaacccggaagccaactacagaaaggcgatccgccttcaggcaaaggtgcctggcctggttgcagcgttttccagaattcgcaagggtcttgagcctgttgaaccgagagaagattacggtattgcggagaattttctttacacattaaacggtgaagagccttcaccaattgaagttgaagccttcaacaaagcattgattttacatgctgaccatgagctgaacgcgtcaacgttcacagcgagggtctgcgtcgcaacactttctgacatctattcaggcattactgcagcaatcggcgcgctgaaagggcctcttcacggcggagcgaatgaaggcgttatgaaaatgctgacagaaatcggtgaagtggaaaacgctgagccgtacatccgcgctaaacttgaaaagaaagaaaaaatcatgggattcggccaccgtgtgtataagcatggtgatccgcgcgcgaagcatctgaaagaaatgagcaagcgcctgaccaacctgacaggcgaaagcaaatggtatgagatgtcgattcgtatagaagacatcgtcacatcagagaaaaagcttccgcctaacgttgatttctattcggcttctgtatatcacagcctcggtattgaccatgatttgtttacaccgatttttgctgtaagcagaatgtccggctggctcgctcatattcttgagcagtatgacaacaaccgtctgatccgcccgcgcgcagattacacgggccctgacaaacaaaaattcgttccgattgaagaaagagcctaaagaaccattggaggctggcttgcgttaatgaggttagcctcttgttcagaacatcaaaagtggtttacactttaaattgaatgttaggaaaaatcattttattttctatataagaaaaataaaatgttttctaaatatgaattacatactgggaggtttttattgtggcacaaggtgaaaaaattacagtctctaacggagtattaaacgtaccaaacaacccgattatcccatttatcgaaggagacggaaccggtcctgatatttggaacgcggcttcgaaggttttggaagcagcagtagaaaaagcatacaaaggcgaaaagaaaattacatggaaagaagtttacgccggagaaaaggcttataataaaacaggtgagtggctccctgctgaaacattagatgtgatccgcgaatatttcatcgcgattaaaggcccgttaacgacacctgtcggcggcggtatccgttctttgaacgtagcgctcagacaagagcttgacctattcgtctgcttaagacctgtaagatactttactggagtgccgtcaccggtaaaacgccctgaagatactgatatggtcatcttccgtgaaaatacagaagatatttacgcaggcatcgagtatgcaaaaggctctgaagaagtgcaaaagcttatcagcttccttcaaaatgagttaaacgtcaacaaaatccgtttccctgagacatcaggtatcggcattaagcctgtttcagaagaaggaacaagccgcttggtcagagctgccattgattatgcgatcgagcatggccgcaaatctgtaacgcttgttcacaaaggaaacatcatgaagttcacagaaggcgccttcaaaaactggggctatgaacttgctgaaaaagaatacggagataaagtcttcacgtgggctcaatatgaccgcattgctgaagaacaaggaaaagacgctgccaacaaagcgcaaagcgaagcggaagcagcaggaaaaatcattatcaaagacagcattgctgacattttccttcagcagatcttaacgcgtccaaacgagtttgatgtcgttgcgacaatgaacttgaacggagattacatttctgatgctcttgctgcgcaagtcggcggaatcggcattgctcctggagcgaacatcaactacgaaacaggacatgcgattttcgaggcgacgcacggaacggctcctaaatatgcaggccttgataaagtaaacccatcttcagttattctttcaggcgttctgcttcttgagcatttaggatggaacgaagcggctgatttggttatcaaatctatggaaaaaacaatcgcttctaaagtcgtaacttacgattttgctagattaatggacggcgcgactgaagtgaaatgttcagagttcggagaagaactgatcaaaaacatggactaagcaaggaaaaagcctaaaactagccataaaggagaagagagacatgggaaatactcgtaaaaaagtttctgttatcggagcaggttttaccggagctacaactgcatttttaatcgctcaaaaagagctggcagacgttgttcttgttgacattccgcaattggagaacccgacaaagggaaaagcgcttgatatgcttgaagcaagcccggttcaaggctttgacgcaaaaattacgggaacatccaattacgaggatacagctggctctgacattgtagtcattacagccggtatcgcaagaaaacctggtatgagcagagatgatctggtctctacaaacgaaaaggttatgagaagcgttacgcgggaaatcgtgaaatattctcctgactctattattgtggtgctgacaaatcctgttgatgcaatgacatacgcggtgtacaaagaatcaggcttccctaaagagcgtgtaatcggccagtccggtgtgcttgatacggcaagattcagaacatttgtggcagaggaattaaacctgtcagtgaaagatgtgactggtttcgtactcggcggacacggtgacgatatggtgccgcttgtgcgttattcttatgctggcggtatcccgcttgaaactcttattccgaaagaacggattgacgcaattgtggagcgcactagaaaaggcggaggcgaaatcgtgaatcttcttggaaacggaagcgcgtattatgcgcctgcggcttctctgacagaaatggtcgaagcgatcttgaaagatcagcgccgcgtccttcctacaattgcttatcttgaaggggaatacggctatgaaggcatctaccttggtgttcctacaattgtaggcggcaacggtcttgagcaaatcattgaacttgaactgacagactatgaaagagcgcagctgaataaatcagttgaatctgtcaaaaatgtcatgaaagtattatcctaataaaaagagagaaaggcttgcttaatacagcctttctctttttactataaatgaaagcgctatcataagcgtctttatttcttttaaaaatgatgtaaaaggcgaattgtcggaatgtcctgctttcgctaaaataaaatcatgaaacatgttaagatgacataaaatagagaaataggatgtcggggaattataatactggaggcacagcatgaacaagaaaattttagttgtggatgatgaagaatctattgttactcttttacagtacaatttggaacggtcaggctatgatgtcattaccgcctcggatggggaagaagcactcaaaaaagcggaaacagagaagcctgatttgattgtgcttgatgtgatgcttccaaaattggacggaatcgaagtatgcaagcagctgagacagcaaaaactgatgtttcccattttaatgctgacagcgaaggatgaggaattcgacaaagtattagggctggagctcggtgctgatgattatatgaccaagccgttcagtccaagggaagtaaatgcgagagtcaaagcgattttaaggcgttcggaaatagctgcgccctctagtgagatgaagaacgatgaaatggaaggccagatcgtaatcggcgatctgaaaatcctgcctgatcattatgaagcgtactttaaagaaagtcagcttgaactgacaccgaaagaattcgaactgttgctctatttaggcagacataaaggcagagttctgacaagagacctgctgctgagcgcagtctggaattatgattttgccggagatacgagaattgttgatgtgcacatcagccatcttcgcgacaaaattgaaaacaataccaaaaaaccgatctacattaaaacgattaggggattggggtataaactggaggagccaaaaatgaatgaataaataccgtgtgcgccttttttctgtattcgttgtctgtatgattctggtgttttgtgttctcgggctgtttttacagcagctttttgaaacatctgatcaaaggaaagcagaggaacacattgaaaaagaagcaaaatacttggcttcgcttcttgatgccggcaatctgaataatcaagcaaatgagaaaatcattaaagatgcaggcggcgcgcttgatgtgagcgcatccgttatcgatacagacggtaaggtgctgtatgggtcaaacgggagatcggctgattcccaaaaggtgcaggcgcttgtttctggccatgagggtattctgtcaacaacagataacaagctttattacggactttcacttagaagcgaaggtgaaaaaacaggatatgtgctgctttccgcctctgaaaaaagcgacggcttaaaaggcgaattgtgggggatgctgacggccagtctttgtaccgcatttatcgtcattgtttatttttattccagcatgacctcacgttataaaaggtcaattgagtcagcgacaaatgtagccacagaactctctaagggcaactacgatgcacggacgtacggcggctatattaggcgttctgataagctaggacatgcgatgaacagccttgccattgatctgatggaaatgacgcgaacgcaggaaatgcagcgggatcggctgctgacagtcattgaaaacattggctccgggctgattatgatcgacggaagaggctttattaatctcgtaaacaggtcttacgccaagcagtttcatatcaatccgaatcatatgctgcgccgtctttatcacgatgcatttgaacatgaagaagtgatccagcttgtcgaagacatttttatgacggagacaaagaaatgcaagctgttaagactaccgatcaaaatagaacggcgttattttgaagtggacggtgttccgattatggggccggacgatgaatggaaaggaattgtgcttgttttccatgacatgacggaaacaaagaaattagagcagatgaggaaggattttgtggccaatgtttctcatgagctgaaaacgccgattacgtccataaaagggtttacggagacgttattggacggggcgatggaggataaagaggcgctttctgaatttctctctattattcttaaggaaagcgaaaggcttcagtctttggttcaggatttgctcgatctctcaaaaatcgagcagcaaaatttcacgctcagtatcgaaacgtttgagccggccaaaatgcttgttgagattgaaacgcttctgaagcataaggcggatgagaaaggcatctccttgcacctgaatgtcccgaaagaccctcaatatgtatctggtgacccgtacaggctgaaacaggtatttcttaatctcgtaaacaatgcgttaacctacacgcctgaggggggctccgtggctatcaatgtaaagcccagagaaaaagacattcagattgaggttgccgattctggaatcggaattcagaaagaagaaattccgcgcatctttgaacgcttttaccgcgtagataaagacagaagcaggaattcgggaggaaccgggctgggccttgcaattgtcaagcatttaatagaggctcatgaagggaaaattgatgtcacaagcgagcttggacggggaactgtctttaccgtgacgctgaaacgggcagctgaaaagtccgcctaatgtttacaaaggtttaacaatatcttcatgcactgttaaacctatgctggtaggatgtagtagaaccccttcatccaaggagccaattttgacggcgggaacctatttgtgttcccgtccttttttgtgtcttctcttatagttcacgtattttcctttcaaattgaactttgttaaaataagaggagctaatgactatgtaagagatgaatggaagcctgaggcttcttaggaggaaattgaatgacggaacgaaaaaaattagtgcttgtagacggaaacagtctggcttaccgggcgttttttgcattgccgctgttaagcaatgataaaggtgttcatacaaatgctgtatacggctttgcgatgattttgatgaaaatgcttgaggatgaaaaaccgacgcacatgctggttgcgtttgatgccgggaaaacaacatttcgtcacggcacatttaaagaatataaaggcggcagacagaaaaccccgcctgagctttccgaacaaatgccgtttatccgcgagctgctggatgcctaccagatcagccgctatgaactggaacaatatgaagcggatgatattattggcacactggccaaatcggctgaaaaagacggatttgaagtaaaggttttctcaggggataaggatttaacccagctggcaacggacaaaacgacagttgccattacgagaaagggaattaccgatgttgaattttacacaccggagcatgtcaaagagaaatatgggcttacgcctgaacaaatcattgacatgaagggtctgatgggcgattcctcagataatattccgggtgtgcccggcgtcggagaaaagactgcgattaagcttttaaaacaatttgattccgttgaaaagctgctggagtccattgacgaggtgagcggaaagaaattgaaggaaaagcttgaggagtttaaggatcaggcattgatgagcaaggagcttgcgacaattatgacggatgctccgattgaggtatctgtttccggcctggaatatcaaggctttaatcgtgaacaggtcattgccatctttaaagatcttggcttcaacacgcttcttgaacggcttggagaagacagtgcagaagcagaacagaatcaatcgttggaagacattaatgtcaaaacagtcacagacgtgacaagcgatatattggtttctccatccgcatttgtcgtcgaacagattggcgataattatcatgaagagccgatcctcggattttcgatcgtaaatgaaacgggagcttatttcattccgaaagacattgccgttgagtctgaggtgtttaaagaatgggtggaaaatgacgagcagaagaaatgggtcttcgacagcaagcgagctgttgtcgctttgcgctggcagggcattgagctgaaaggagccgagtttgatacgctccttgcggcttatatcatcaacccgggcaattcatatgacgacgttgcgagtgtggctaaggattacggcctgcatatcgtttcaagtgatgaatcagtttatggaaaaggagcaaaacgggcagtgccgtcagaagacgtactgtctgagcaccttggccgaaaagcgttagcaattcaaagccttcgggaaaagctcgttcaggagctggaaaacaacgaccagcttgaactgtttgaagagctggaaatgcctcttgcgcttattcttggcgaaatggaatcaactggcgtcaaggtcgatgttgaccgtttaaaacggatgggtgaagaactgggtgcgaagctgaaggaatatgaagaaaaaatccatgagattgcgggagagccgtttaacatcaattctccgaaacagctaggcgtcatcttatttgaaaagatcggccttcctgtcgtaaagaaaacgaaaacaggctattctacgtctgccgatgtgcttgaaaagctggctgacaagcatgatattgtcgactatattttacagtacagacaaattggcaagcttcaatcaacatatatcgaagggcttttaaaggtgacgagaccggattcgcataaagtgcacacgcgatttaaccaggccttaacgcaaactggccgtctcagctcgactgatccgaacctgcaaaacattccgatcaggcttgaggaaggccggaaaattcgccaagcttttgtgccgtctgaaaaagactggctcatttttgcagccgattattcacaaatcgagctgcgggtgcttgcccatatttcaaaggatgaaaatctgatcgaagcttttacaaatgatatggatattcacacgaaaacggcaatggatgtgttccatgtcgctaaggatgaagtgacatctgcgatgagacgccaggcgaaagcggtcaactttggcattgtttacgggatcagcgattacggtctgtcacagaacctcggcattacccggaaggaagcgggagcatttatcgaccgctatctggaaagtttccaaggcgtaaaagcgtacatggaagattcagtacaggaagcgaagcaaaaaggatacgtaacaacgcttatgcatcgccgccgctacatccctgagctgacgagccggaactttaatatccgaagttttgcggagcggacggccatgaatacgccgattcaaggaagcgccgctgatattatcaaaaaagccatgattgacatggctgccaagctgaaagaaaaacagttgaaagcaaggcttctgcttcaagtacacgatgaattgatttttgaggcgccaaaggaagaaattgaaattcttgaaaagcttgttcctgaagtgatggagcatgcgcttgcattagatgtgccgttaaaggtggactttgcatcaggcccatcttggtacgatgcgaaataaacagagataggaagtgatggatgtgccggaattaccagaggttgagacggtccggcgcactctgaccgggcttgtaaagggaaaaacaatcaaatcggtagagatcagatggccgaatatcatcaaacggcctgccgaaccggaggaatttgcgcgaaaactagcaggagaaacgatacagtccatcggaagacgaggaaagtttttactgtttcatttagatcattatattatggtttctcaccttcgaatggaaggaaaatacggtcttcatcaagccgaggagcctgacgataaacatgtgcatgtcatattcacgatgacggatggaacccagcttcggtacagggatgtgcggaaatttggaaccatgcacttatttaaaccgggagaagaagcgggcgagctcccgctttctcagttaggtccggagccggatgcagaagaatttacgagtgcgtatttaaaagaacggcttgcgaaaacaaaccgcgctgtcaaaactgccctactggatcaaaaaacggtagttggactagggaacatttatgtggatgaggctcttttcagagcgggtgtccatcccgagacaaaagcaaatcaattatcagataaaacaatcaaaacccttcactctgaaatcaaaaacactctgcaggaggcgattgatgcgggcggaagcacagtccgttcatatatcaactcccaaggggaaatcggaatgttccagctgcagcattttgtctacggaaaaaaagacgagccatgcaaaaattgcggaacgatgatttcgaaaattgtcgttggaggaagaggcacgcatttttgcgcaaagtgccagaaaaaaaagtagcataatgcttcatcgtccaagctgtcggtgcatatatcagtaactctgtaatggaggatgccattttcgaaacacggatttttcactttcccatatatatgattgtgatgaatcccgggcatttcacatctgatacaagagcaccaacagaaaggaagaaacggatatgcaaatggtttctatactgctgctggcgttggctgtcagcttggacagtttttcagtcggatttacgtacggattgagaaaaatgaaaataccgtttaaagcgattttggttatcgcctgctgttccggtgctgtcatgtttatatccatgctgatcggaagctttctcacgaagttttttcctgtatatgtgacggagaagcttggcggtttgatattggttggaatcggtgcgtgggttctgtatcaatttttcaaaccggcaaaagataaagaatacctattgcatgaaaaaacgctgcttaatttagaggttcggtcattagggattgtgattcatattttgagaaaacccatgagtgcggatatcgacaaatcgggtgtgatcaacggaattgaggcggtcttattgggatttgccttatcgattgatgcctttggagcaggtataggcgcagccattctcggtttttcgccgattgtgatgagcatcgccgtggcaatcatgagctcgctgtttgtatcaattggaatcaatgccggccattttctgtctaagtggaaatggatcgataaaatggcgtttttgccggggcttctattaatcacgattgggctctggaaattgtaaaaaggagtggatctcttgaccttagtcattggtttaacgggaggaatagctagcggcaaaagcacggtagccaatatgctgattgaaaaaggaataacagttatagatgcagatatcattgcaaaacaagcggtagaaaaagggatgccggcctaccggcaaatcattgacgaattcggtgaagacatactgctctcaaatggcgatatagatcgaaaaaagcttggagcgctggtatttacaaatgaacaaaagcgtctcgctttaaatgcaattgttcatcccgcagtcaggcaggaaatgctcaagcgccgggatgaagccgttgcaaatcgggaggcatttgttgtattggatatcccgctattgttcgaaagcaaattggaatcattggttgataaaattattgtggtcagtgtgacaaaagagcttcaactggaacgtctgatgaagcgcaatcagctgacggaagaagaagcagtcagccgtatccgctctcaaatgcccttagaggaaaaaacagcaagagcagatcaagtcattgataacagcggcacgcttgaagagaccaaaaggcagcttgatgaaatcatgaacagctgggcataatacaaaaaacaccgttcatattgaacggtgtttttttgccattaaaaatcaaagttgtccggatcaggaccgacgcgcaagttttcattcagtgcatcgattcggttcatgtcatcctgcgttaattcaaagtcaaatacgcttgcattttctttaatgcggtgttccttcgttgatttaggaatcgtaatgatgccatgctgcagatcccagcgcaaaataatttgtgcgacagatttattatatgtttgagcgatgtcagccaatacagggtgatccagcagctgtccctgcattaaaggtgaccaagcctccatctggatgccctgattttggcagtatcttatcaactctttttgtgtgaggcgcgggtgaaattccacttggttaatcataggcttaatttcagctgccgtcatcagatcttcaagatggtgaatttggaagttgcttacgccaatcgctttgatacggccttctttatacagcgtttcaagcgctctccaagcttctttatactttccttctacaggccagtggatgaggtatagatccaaataatccagaccgagtttggacagacttgtttcaaaagcggcgagtgtttcttcgtagcctaaatccgcattccatactttcgatgtgataaacagatcctctcttgaaatgcctgctttttcaatgccttcccgaatcccttctccgactccagcttcatttccatagattgctgcagtatcaatactgcggtacccgtgaacaatggcagttttaactgcgtttaccagttcagatccttcttccacttggaacacgccgaggccgaaccaaggcatttctaccccattatgaagtgttgcttttgcttgtaaatgtgttgtcatgttcatttcctcctttaaaattgtcaggcttcctgccgatctcgtttttccatcaagcggctccagcctgttaaaatgactgcaccgaccaccattaatccgcctatccaagcggtatgaatcaatccgattgaatcggtgatcacaccgccaaggtatgacccaagcgcgatccctgcattaaaggcagcgatattcatcgcggatgcgacgtcaactgcactcgggacaaaacgctcagccagcatgacgacatacacctgaaggccgggcacgttcataaaggccagcaatcccatacagagaatggtaatgagcccagctgcttgatacggggctgtaaatgtcagtacgaatagaacaattgcctgtacgataaacatatagaataaagcggcaatcggatttcggtttgacagctttccgccaatcatattgccgatagcaatagctattccgtatccgagcagaatcactgcaacagtcccggctttgaagcctgttacttcctgaagcaggggagacagatacgtgaacacaacgaatgttcctccgtatccaagcgctgtaatgacaaataaaagcaataaccggctgtttgtcacaagcttcaattgatcccgcatcgttgttttcgtcccttttcgtaatttggacggtacaagaatgccatttgtaatgaaagcaatgattccgacggcgataatgaccataaaggcgaaacgccagccgaactgctggccgataaatgtcccaaaaggaactccggttacagttgccacagtgaggccagtaaacataattgaaatcgcgctagcccttttatcttccgggacaatatccgctgcgattgtcgaaccgatcgacataaacacaccgtgcgaaaatgccgatatcacacgtgctgctagtaaaatcccgatgcttgaagcggttgctgccatcgtattaccggcaataaaaataaacatgatccaaagcaatagtgtcttacgtgacatgcttgaggtcaatgaagttaatataggtgccccaaatgtaacgccgagcgcataaagggaaacagtcaatcctgctgtcgtgacgggaatatccaggtcatcagcaatgagcggcaaaaggccgacactgataaattcagttgtccctattgcgaatgcacttacggccaaagccagtagtgcaggaatactgcttttattggctgaagtcatgatgttcctcctttgtaagatgtgttgtatgattgaaattctgccgagtaagctatataaataaaaaagagcagattcaaatcagccggcaaatgtgattatgaaacatatcgttaagaaataaaagtacgtactttgaagtgctatagtcactttttggtgcctgtgaggagaatggattgtatggagaagaaaaaatataacatttctgttgaagcgactcttgaagtgatcggtggaaaatggaaatgcgtcattttatgccatctgacgcacggaaaaaaacgcacaagtgaattaaaacgcctaatgcccaacatcacgcaaaaaatgctgactcagcagctgcgcgagctggaagcggacggtgtcattaaccgaatcgtatataatcaagttcctcccaaagtggaatacgagctcagcgaatacggccgcagcttagaagggattttagatatgctgtgtgcttggggagcgaatcatattaacagagtgtacggggatacattttctgtgctagaagaaagtgtgctcaatgataagttaaaacaggaatcataaagcatgagggcagtcagtgcggagcgctggctgctttttggttcttacgcctgatattctgtgcaagaaaacataagatgcatcataaattagcgttataatcgttgatttttatcaatatgtactggcgaatttgttttaatgtgttatactaattttagatagtaacaaattaggatggcataattgataaggggtgtccaacatgaaggtaaaagtagcgatcaacgggtttggaagaatcggaagaatggtttttagaaaagcgatgttagacgatcaaattcaagtagtggccattaacgccagctattccgcagaaacgctggctcatttaataaagtatgacacaattcacggcagatacgacaaagaggttgtggctggtgaagacagcctgatcgtaaatggaaagaaagtgcttttgttaaacagccgtgatccaaaacagctgccttggcgggaatatgatattgacatagtcgtcgaagcaacagggaagtttaatgctaaagataaagcgatgggccatatagaagcaggtgcaaaaaaagtgattttgaccgctccgggaaaaaatgaagacgttaccattgtgatgggcgtaaatgaggaccaattcgacgctgagcgccatgtcattatttcaaatgcgtcatgcacgacaaattgccttgcgcctgttgtaaaagtactggatgaagagtttggcattgagagcggtctgatgactacagttcatgcgtatacgaatgaccaaaaaaatattgataacccgcacaaagatttgcgccgggcgcgggcttgcggtgaatccatcattccgacaacaacaggagcggcaaaggcgctttcgcttgtgctgccgcatctgaaaggaaaacttcacggcctcgccttgcgtgtccctgttccgaacgtctcattggttgatctcgttgttgatctgaaaacggatgttacggctgaagaagtaaacgaggcatttaaacgcgctgccaaaacgtcgatgtacggtgtacttgattactcagatgaaccgctcgtttcgactgattataatacgaatcctcattcagcggtcattgacgggcttacaacaatggtaatggaagacaggaaagtaaaggtgctggcgtggtatgacaacgaatggggctactcctgcagagttgttgatctgatccgtcatgtagcggcacgaatgaaacatccgtctgctgtataaaataaggtcatggacacattttaaagaaaaaacccttaacagcatatttctgaaaaaacgcaccttgcaaattagacttaaacacagtatactatttttcgtgaacttcttgcttgagactgtttcggaattacttaaagggttaggacctctccggactaactttcccccgtggtaaatggccgacccagttgttggaatttcactttttaattcttgttaaggggggtccatgactatggaaacaatggggcgtcacgttatctccgagctatggggatgcgattttgataagctgaatgacatggattttattgaaaaaacgtttgtaaatgctgctctaaaatcaggtgctgaggtgcgcgaggttgcatttcacaaatttgcaccgcaaggcgtaagcggagttgtgattatttctgaatcacacttaacgattcacagttttcctgagcacggatatgcgagcattgatgtttatacttgtggagacttagatcctaatgtcgctgctgattacattgcagaggcattacatgctgatacaagagaaaacattgaaataccaagaggaatggggcctgtgcaaattaaacaggcgcaagcgaaagtactataaagtaaattgcgaacacaaagggagctgaagctagaaagccattatgcgctttttagcttatgctccttttatttttataaagaaacgagagtgtcagctttttcttttttcattttttttgtaaaataagaaggagattttcacaaaccacctaatgctatagaaacaaatttaacaacggctctcccgacagatgctgtcacatctatttttaaaaggcggaggctgccgaaaatacattgcagggaacgatatagttgggagctgattttattgaaatgtccttcatgccagcataacggaacacgagtccttgattcacggcctgtggatgacggaaagtcgattcgccgaagacgcgagtgcgaatcctgccactaccggtttacgacctttgagaaagtggaggaaaccccgctcatcgtcgtgaaaaaagaaggtgtgcgtgaggaattcagcagagaaaaaatgctgcgcggcctcataaaagcatgtgaaaaaaggcctgtttcactcaaaacgcttgaagacatgtgctttgatattgaaaaagagcttcggaatcaaggctgctccgaggtgaagagtgagctcgtcggagaaatggtcatggaccggctggctaagattgacgaagtcgcatatgtgcggttcgcgtccgtctatcggcagtttaaagatataaacgtctttatcgacgaattaaaagacttaataaagaaagagcgttaaaagagctaagaggattcttctagctcttttctcatgtgcaaaattggcatttgatagatataagaaacggtgtaaaatgaaaggtagaaacaaattcggaaggtttgagaatgtatggctgactattggaaagatgtactgcctgtagacccgtatgtggttaaaagtagatcgatgctgcaggatattgacagacaaattattacacaactttaccagcccttaatcggccctgttgcattctctctttatatgacattgtggggagagcttgaacaaaaccgtctgtggggcggagagtccacacatagacagctgatggggatgacacagtccaacttaaaaacgatccatcaggaacaggggaagctcgagggcatcggattgctgaaagtatatatgaaagaatccgagcggcaggagcgcctctttatatatgaactccttccgccgctcagaccaaatgaattttttgaagacggaatgctgaatgtttttctgtataatagggtcggaaaaacgaaatatcagcaattaaaacaattttttacgcacccggccatttcagaagatgcgaaggacattacgcgtccgtttaatcatgcgtttgaatcgctgcagccgagtgaatggaagctcacatccgatatggaggaaacggtaaggcttgctgaggggtccgagtatacttctgtcggacagtctccgtcctacaccataacggaggatgtgtttgattttgatttgtttttagcgggactttctgagacgatgataccgagaaaagcgatgacccagcaggtgcgggacacaatcaaaaagctttcttatctgtacggaattgaccctttgcaaatgcaaaatgttgtgatgagcgcaattgatgagcgtgacgtcattacgacggaggcattaagaaaagcggcgagcgactggtatcaaattgaaagaaacggacagctgcccgatttggtggaaaaaacacagccggtgcatctgcgtgaaggcgaaaaaccggcagaagaggattctttggatgggaagctgatcgcattgctggaggcgatttccccgaagaagcttctgcaggacattgctgacggaacagagccgtcaaaagctgatctgaagatcatagaagaaattatgttcgaacagaagctcgagccaggcgtcacaaatgtgttaatttattatgtcatgctgaaaaccgacatgaagctgtcgaaaaactatatccaaaaaatcgcttcgcattgggcacgcaaaaaggtaaaaacggtcagggaagcgatgaagctcgcaatagaagaaaaccgccagtatcttgaatgggctgaaggaaaaacaaagtcttcgaaacgaaaccaaaaagtgattcgtgaagaaaagcttcctgattggatgacagaaaaggaaacagcgtctgactcagaatccggacagcagaagctgcatccgcaggatttggaagaacagaagaaaaagatgatggaagaaatgcaaaaactgaaaaaatactctgcctattaaagacagagatgcggggtgaaggaatagatggaaccaatcggccgttccctgcagggcgtaaccggcaggccggatttccaaaaacgtcttgaacaaatgaaggaaaaagtcatgaaagatcaagatgttcaagcatttttgaaggaaaacgaagaagtgattgaccaaaaaatgatcgaaaagagcttaaataagctttatgaatatatcgaacaaagcaagaattgctcctattgttcggaagatgaaaactgcaacaatttgttggagggctaccatccgaagcttgttgtcaatgggaggtctattgatatcgagtattacgaatgtccagtcaaacggaagctcgaccagcagaagaaacaacagtctcttatgaaaagcatgtatatccagcaggatcttcttggagcgacgttccagcaagttgatatcagtgacccaagcagactcgcgatgtttcagcatgttacagacttcctgaaaagctataatgagacgggaaaagggaaaggattatatttatacgggaaatttggggtaggaaaaacgtttatgctcgctgcaattgccaatgagctggcggaaaaagagtattcctccatgattgtttatgtgcctgaatttgtgagagagcttaagaattcgctgcaagaccagacattggaagagaagctcaatatggtaaagaccacacccgtattaatgcttgatgacatcggagcagaatcaatgacaagctgggtaagggatgaggtcatcggaacggtgcttcagcacagaatgtcccagcagctgccaacgttcttttcttctaatttctcacctgacgagctgaagcatcattttacgtattcgcagaggggagaaaaagaagaagtaaaagctgcaagattaatggagcggatattatatttggctgctccgatccgccttgacggagaaaaccgccgacatccataattgctgtggttcaaaggggaaggaactgagggtatgaaacgaaaaacggctgtcaaatggctggcagtgcttgcaggtgctggtttactctattggggaaataaaacgtatttgaatgtatcgccgaaagaaatcaggatatgggtattgtcgttcggagtctttgcacctctgatgtttatcgggatatccatcgtcaggccacttgttttatttccggtgtctgttatttcaatagctggcggacttgcgtttggcccgcttctcggcacgctttatacgttattcggttcgatgtgcgcttcagctgtttcgttttttgcggccggtttgttttcggcgaaaaagaacgggcattacgaaaggcttgaagccatacagaagcaaatggaggataacggatttttctatatctttcttttgagaatcctgccgatcaattttgatttcgtcagctatgcggcaggcctttccaatgtcaaagcgctgccgtattttgccgcaacggctgtgggaatcatccctgggacgattgcgcttaatgtgctgggtgcgagctttttggctggcaatctgcccgctttctttatggtgctcgctttgtatatcgtgtttatctcactgccgttcatcttcagaaagaaaatgcaaaacttgttccaagaatcaaattaagatttgccagtgacctttacgtctattttaaaaacatcccccatatacttgtaacagatgccgtaaggggggacaaacatgcttgaaataatctttgaagatgaccatgatacagccgcttttttacatctcattcagcattcggacgatcggaacaatatcattgtccgtgaaggcatacgaaaaatcgggattgaaaaagcgaatccggcttttcctattcagcgttttatggagccgattctggtcaaattttttttggaatgcaaagaagacgagcatatgctgtcattgattgaggaaacttattgtttcacggaccaggatgaacagcagcaaatccttcagctcgcacacagtattattgaaggtgaagcagccgatcttccgtttgagccgctgaagctttcacggaaacaatctattttggatgaactccaaacgatctgtttagaggaaggagtattttacattcgctcctttcagaccttccgacttggatcatactataagcagctgagagatattacagaagcagcgattgatgaatataagatggaacaggaatatcaaaactttattcaaacactcagagactatgtaaacgccaaacagccgcgaatcaaaaaagtgcatattgtccatgatggttcctttacattatgggagttgcgctatgtgccggaacgggaaaaaatgaaatacatagacaggagatttgtccgggatcatcctatgtatattgattctcatttgctcgcgccgctgatttccattgcgcctgatgaagtcgtgctttataccgaccagcccgagcacatgatggcaaggaccattcaaaacgtatttcaagagagagtggaaatgctcccgctgcatgcttttacagatgcagaaataccggtgaagcactcggaaggatgagggccggcagcctgtctatataaggctgtcggtttaaaaaaaggaaacgcgatcgtgttgattttttggattgaacaatttataatacataggagattaagaaagacacacgtattgataaggacacgaaggaatgataccagctcaaagagagggaagccctggctgcaagcttcccagctaaggaccattcgctttaccgcctttgaacttcagctgtgaacctcttgaaaaggaacagtaatggctgacgggaactcccgttacagagcttagagccgcaggtgccgtattggctttgcggaaaaaagggtggaaccacgattccgtttattcaacctcgtccctttcatagggggcggggtttttatatgcaaaaaaaggagtgacaaagatgtcagatatggtaaaaatcacatttcctgatggagcagtcaaggagtttgcgaaaggaacaacaacagaagatatcgcggcatccatcagtccgggattaaagaaaaaatcattagccggaaaactgaacggaaaagaaatcgatttgagaacgccgatcaatgaagacggtacagtggaaatcattacagaaggctcagaagaaggtcttcaaattatgcgccacagtacggctcacttgctggctcaagcgattaaacgcatctacaaggatgttaaattcggcgtcggtccggttatcgaaaacgggttttactacgatgtagaaatggacgaagcgattacaccggaggatctgccgaaaatcgagaaagaaatgaaaaaaatcgttaatgcgaaccttccgatcgttcgaaaagaagtcagccgtgaagaagcgaaagcccgttttgcggaaatcggcgacgacctgaagcttgaactattggatgcgattcctgaaggagaaaccgtttcgatctatgagcaaggcgaattctttgacctgtgccgcggcgtccatgttccttcaaccggaaaaatcaaagaatttaagctgttaagccttgcaggcgcatactggcgcggcgacagcaaaaaccaaatgcttcagcgcgtatatggtacagctttcttcaaaaaagctgatcttgaagagcatcttcgtatgctagaagaagcgaaagaacgcgaccacagaaagcttggcaaagaattaaagctgttcgcgaactctcaaaaagtcggacaaggcctgccgctttggctgccaaaaggcgcaacaatccgccgcgtcatcgagcgctatattgtcgataaagaaatcagcctcggctatgagcacgtatacacacctgtgctaggcagcaaagagctgtatgaaacatcaggacactgggatcattatcaggaaggcatgttccctccgatggaaatggacaatgaaacacttgtattgcgtccgatgaactgtccgcaccatatgatgatttacaaacaagacattcacagttaccgcgagcttccgattcgtattgcagagcttggaacgatgcaccgctatgaaatgtcaggtgcgctgtcaggacttcaacgggtacgcggaatgacgttaaatgatgcacacatctttgtgcgcccggatcaaattaaggatgagtttatccgtacagtccgtttaatccaggatgtttatgaagacttcggtttaagtgattacacattccgtctgtcttaccgcgatccggaagatacagagaaatattttgatgacgatgaaatgtggaacaaagcgcaatccatgctgaaagaggcaatggacgaaatcggccacgactattacgaagcagaaggtgaagcggcattctacggccctaaacttgatgttcaggtgaaaactgcgatcggaaaagaagaaacactgtctacggttcagcttgatttcttattgccggaacgtttcgacctgacatacatcggtgaggacggcaagcagcaccgtccggttgtcattcacagaggtgtcgtttcaacaatggaacgctttgttgccttcttaatcgaagaacacaaaggcgcgctgccgacatggcttgcaccggttcagttccaagtcatcccggtttctccggctgtgcatttagactacgcgaaaaaagtgcaggaacgcctgcaacgtgaaggcctgcgtgttgaagtcgacagccgcgatgaaaaaatcggctacaaaatccgtgaagcgcaaatgcaaaaaatcccgtacatgctggtggtcggtgaccaagaagcagaaaacggagcggtaaacgtgcgtaaatacggagaacagaactctgaaaccatttcacttgatgagtttgtgaaaaaggcagtagctgaagcgaaaaaataaaataaaaagcatgatctcgttgaagagatcatgcttttttatttctctaatataggaaacaaatcatgaaggctgctgatgatgtaatcaggcgttacgtcagtttcgtttttcttatccgtccggttgatccaaacggttttgattccggctcttgaagcgcctaaaatatcagtattcaaattatcgccgaccatgatggcatcgtctttttcaatattcatcagcttaaggcagtgttcaaaaattgaaacatccggcttgcccttgccgaatgcgcctgagatgacgatttcattgaagtaaggagcgagctcaggcacgccggcaagcttctccttttgcagactcggatcgccatttgtcaaaagcaataattcatacttgccttttaattgatcgagtacagagaaagtttcatcatatacaaacgggcgctttctgcgctctgccgcaaaaaactctcccaagtattcgccatatgcaggatcatcgatcccaagcgctttcagtccgtttgtccatgcatttcttctgtactccggcacaatcttgttcagcttttgaaagccttcactgattggctctgagaaattggaccacagtccttcaaacgggttaatgccgatcatcactgtatatggatacgtctcatatgacatgtacaattctctcgccgcttcgcgaacagctgcttcgaattcctcaggggcaaggccatattttttctccgcctgtaagcaagtttctgcaaatgttgttctgacgcttttctcgtcccaaagtagtgtatcatctaaatcaaaaaatacggctttcatgatcttctcctctgcttcagattcaaatctttctgccaaaaggctcatgttttattttacaatagataaaagccttgtgaaatatgttttcagacgattttaaaaaaacagtcagccgtaaaacgaaaacatgctagaatgaaaacggaaagaacaggtgacatgaatgattcatttaatgattatgatgctggagagagtggggattattgttatattagggttcattctcgcccatacgaaacttttcagacaagctcttcagaatcaggacggctataaaggaaaagcgattttaatttctattttttctcttttcagcatcatcagcaattatacaggcatcgaaattcaaagaaatatgattgtaaacaatgactgggtgtttacgatagatccatcgggctctatcgcgaatacccgtattttgggcgtggaaatcgggggccttctcggaggtccttttgtaggggctgggatcggcatacttgcgggcctgcatcgtttttcactcggtggcagcacggccttaagctgtgccgtctcatctattttagcgggtgttcttgcaggcttgatcggcaggtattttacgaagcgatatcgaatgccgacaccgcgcatcgccgctcttgtgggaatcggcatggagtcactgcaaatgatcattattttgctgatggcaaagccgttcagtgacgcttgggagcttgtcagcatgatcggaattccgatgatactcatcaatggaacaggcagttttatttttctgtctattattcaagcgatcattcgcaaggaagaacaggcaagggctctcgaaacgcatcgagtgctgacgattgctgatcagacacttccattttttcgccaaggattaaatgagaactcctgtaaaagtgtagcggctattatccataagctgacaggaacagatgcggtgtctctcactgacaaagaaaagatccttgcgcatgtcggtgcgggaatggatcaccacatcccatcgaaaagcttgatcaccggcctgtccaaaaaggtgattaaaacagggcatattatgaaggcgatttcgcaggaagagattgaatgcacgcatgctgaatgccctttgcacgctgcaattgtcctgccgctgacatctaacggcaatacaatcggcaccttaaaaatgtactttaaaagcccggcaggcctgagtcaggtagaggaggaacttgccgaggggctggccatgctgttttcgacacagcttgagcttggggaagcagagctgcaaagcaaacttctcaaggatgctgaaattaaagcgcttcaagcacaggtgaatccgcattttttatttaatgcgatcaacacgatttctgcgctatgccgtacagatgttgaaaaaacccgtaagctcctattgcagctcagtgtttattttcgttcaaaccttcaaggagcgagacagctgctgattccgctctcaaaggagctgaaccatcttaacgcctatttgtcattagaacaggcgcgttttcccgggaaatataaaattgagcttaatatcgacagcagactggagcagattgaaatccctccgtttgttttgcaggtgcttgtcgagaacgcgcttcggcacgcgtttccgaaaaaacaagacatatgcaaggttacagtctgtgtcttatctgataacgcatccgtctatatgaaggtggcggataacggacgcggaattccgccggacgtcttgccggaactggggaagaaaccgtttccgtctaatgagggaaccggtacagcgctttataacctaaatcagcggctgatcggtttattcggacagcaggctgcactgcatatcagcagtgaggttcataaagggacagaggtttcctttcaagtgccaatgcaacagatgaaagagggagaagaacatgctcagggtgttaatagttgatgatgagatgctggcaagggatgaactggcttacttgcttaagcggaccaatgaggaaatggtaatcaatgaagcggaaaatatcgaatccgcttttgaccaaatgatggaccaaaaacctgatttgctgtttttagacgttgatttatccggagaaaacggttttgatatcgcaaagcgattgaagaaaatgaagcatcctcctgctgttgtgtttgcgacagcgtatgaccagtatgcgctcaaagcgtttgaggtggacgctcttgattatttaaccaagcctttcgatgaagaaagaattcagcaaacgctgaaaaaatataaaaaagtcaatcgggatattgtagaaacagagcaaaacagccatgccggccagcacaagctcgcgctatctgtgggggaatcgattgtgattgtggatacgaaggacattatctataccggaacagaagatggtcatgtcaatgtaaaaaccttcgatcattcttatacggtcagcgatacactcgttgtgattgagaaaaagctgccggattctgattttatccgcgtccatcggagctttgtcgtgaataccgaatatattaaagaaattcagccatggtttaattcaacgtataatctgatcatgaaagacggatcgaaaataccggtcagccggacatatgcgaaggaattgaaaaagctgctccatatttgatgggcggctttttgcatttcagccatttgattctgcaactcagacccgttatacggcatgttatcttgtaagcgctttataacagagaattcttatttataatgagggtaccaaagagaaagaggtgaagaaaatgagtgctaaaaaagtgtacgggtttttaacacaagcatttatttttgccgtcattatgctggtttcaaatatgattgccgctattgtcccaatacctatcccggcatcggttgtagggttggtcttattatttctcctattatgtttgaaagtcattaaactggaacaagtggagacgctcggaacgtctttaacctctctgatcggatttttatttgttccatcaggtatatctgttatgaattcgcttggtgtgatgcagcaatacggcctgcaaattgttcttgtcattctgctcgcaacgattattttgctgggggctacgggattgttttctcagctgattctgtcgctgagcggaaaacgcaaaaccgcagcggacatgaaaacaaaaacagtgcaaagcccgcagaacaataacgaactcgttcaccattaagggaaacaggaggttcttcacatggaaagcacaatgagtccttattttgggattgtcgtatcacttgctgcattcggcatcggcacctttttatttaagaaaacgaaaggcttcttccttttcactcctttgtttgttgccatggtgctggggatcgcatttttaaaaatcggcggtttttcctacgcggattataataacgggggagagatcattaagtttttccttgaaccggcaacgatcgcatttgcaattcctttgtacaaacaaagagataagcttaaaaagtactggtggcaaatcatggcctccattattgccggctctatctgctctgtcacgattgtttatttgctcgctaaaggcattcatctcgattcggccgtaatgaaaagcatgcttccgcaggcggctacaacggcaattgcgcttcctttatcaaaaggcatcgggggcatcagcgacatcacagcctttgcggtcatctttaacgctgtcatcgtatatgcgctcggagcattgttcttgaaggtgtttaaagtgaaaaatccgatttctaaaggattggctcttggaacatccggacatgcacttggtgtagcggtcgggattgagatgggagaagttgaagctgcgatggcaagtattgctgttgtcgtagtaggagtggtaacggttctggtcatccctgtgttcgtgcagctgatcggtggataagccaaggctgaatgccttggctttttttattttatggtgcgtcttcgggatcgatatacccttgtttaatgccccattctacttgatcgtcatgccacttttttcgttcttcataaccataaccatcgtcatcaggaagctctgaagctggctgttgaatggttttatctgtctgactcgaggaagatggtggatcttgactattagatgagggtgcctcagtctgctgccgttgtgcctgcgattgccgctttttctcagcgttcgctttctgctctttttggattgctgcctgccgctgtctttcaagttcagcttgtctttccgcttcggctaatcgctgtctctctgcagcctgctgctctgctaatcgctgtctctccgctttttcctcctgctgtttctttcgtttcgcctcccgctctttttcaagctttttctcagcggcgatttgtctttgcttttcagcttcttcttttgccttccgctttcctaactcagtagcgagtggactctcgaacttcatgtccaatgaaacgggttttagtttttttagctctttctccagttccttttgaggaaatgctgcagttgttttaacagtggtttcgacttttgattcggaagatgtgctgctattcgagcaaccggttaacatcaatgtgaaaaataaagcaagctgtatcagtttgttcatgtgtcaggctcccttctgctccttatatcggtcagagattaactttgttttacatttcttcctgtcggtggttttgttgtaaattgcgtaataagggggaattgttggttctttgcattctgggtggggatgaaagattttctttttctctcttgcgctcatagaaaacccatgttacaatgtaaaagttgttccggataagtcgtccttgactaaagatccggtattgtgtagaatagttattgaattgaatataaatcacaagcagaagcacccgcttctcacctgattgacacatgcatgtagttggcaggttgaccgtacatttttattgatacagatgttcgtagtgtgggtgttttataatgcccacactttttgtttgcctgcaaaatgcattcaaaatgagttgtgaatcaattcgaagaaactatggaggtggctcattattagcaaagatcaattggttaatgagggtatccgtgcacgtgaggtccgtttaatcggacaaaatggcgaccagcttggaatcaagtcccgtcaggaagcacttgaaatcgccggccgcgcaaatcttgaccttgtgttagttgcagcgaatgcaaaaccgcctgtctgccgaatcatggactacggtaagttccgatttgagcagcagaaaaaggaaaaagaagcacgcaagaatcaaaaaatcattaacttaaaagaagttcggttaagtccgacaatcgatgagcatgactttaacacgaaattgcgcaatgcgattaaattccttgaaaaaggcgataaagtgaaagcttctatccgctttaaaggacgcgcaatcactcataaagaaatcggtcagcgtgtattagaccgtttctccgaagcatgtgctgaggttgcgacagtcgaaacaaaaccaaaaatggacggccgcagcatgttcttaatgctcgcaccgaaaaacgaaaagcaataaggaggaaatcccatgccaaaaatgaaaactcaccgcggatctgctaaacgttttaaaaagacaggttctgggaagttaaaacgttctcacgcgtacacaagtcacttattcgccaacaaatctcaaaagcaaaagcgtaagcttcgcaagagtgctgttgtaagcgcaggagacttcaaacgtatcaaacaaatgcttgctaacatcaagtaatcggataaggaacaattaggagggaaattcaatgccaagagtaaaaggcggaactgttacacgtaagcgtcgtaaaaaggttcttaaattagcaaaaggttatttcggttcaaaacatacattatacaaagtagctaaccagcaggtcatgaaatctggaaactatgctttccgtgaccgtcgtcagaaaaaacgtgatttccgtaaactttggatcactcgtatcaacgcagctgctcgcatgaacggcctttcttacagccgtttaatgcacggtcttaagctttctggtatcgaagtaaaccgtaaaatgcttgctgatcttgctgtaaacgatcttactgcattcaatcagcttgctgatgctgctaaagctcaattaaacaagtaatcatatagagccgctctccagcagagcggctttttctatataaaggatgaggcaacatgattattgctgcttatttggtgttgattaatctgtgcggtttttgggtgatgggcattgacaaacgcaaagcgcagcagcacaagtggagaatttctgaagaccggctgtggctgatagccatcgtgtttggagcgctcggtgtctggcttggcatgcaaaccttcagacataaaacgaaacacgcttcttttaagtatggagtaccgcttcttctggtaattgaagcgattctcatcgctatttactacagcccgtttgatttataaaaagcagaaaagcgtttaacgctcttctgctttttttgcgagtttaatgggctggtcccagtcaatcttacaatttggataccgttccagcactttttcttcaatgttctcaaaatcttttgcagagaaatgtttcagcttctcaggagattctgtccagacaaagatcgtgtgaataaacagcggatgatccttggaaggaatatgcttttctccctcaaaaagcacgcctttatacgtcagctgaaaattcttccgggtattgttttgttcatcaataatataaaaatgttcttttgattgggccagcttaagccttctcttaggattcgcgacatatttgaccacggcataaatacaataagcaaaaagtgcaagcaaaataatccttagaaccatgacaaacattgtgtgaaggcacctcccttatggtgatgatctgatgtaatacgaaaagcatagaaaaaggtttcactttttctaaaagaaagctgtaaaaacatatacccgattttcaagtgaaatagtcgtatggttagcgctatgttttgtataataagaatgcaggactgatgaaggagggtttggaacatggcaaaattagatgaaacattgaccatgctgaaagatttaacagatgcaaaaggcataccgggcaatgaaagagaagtaaggcaagtgatgaaatcatacatagaaccatttgctgatgaggtgacaacagatcgcctgggcagtttaattgccaaaaaaactggtgcagaaaacggcccgaaaattatgatcgccggacatttggatgaagtcggctttatggtgacacaaatcacagataaaggctttatccgttttcaaaccgttggcggctggtgggctcaggttatgcttgcccagcgggtcaccattgtcacaaaaaaaggagaaatcactggggttatcggatctaagccgcctcatattttgtctcctgaagcaagaaaaaaatcagtggaaataaaagacatgtttattgatattggagcttcaagccgggaagaagccttggagtggggggtacttccgggagatatgatcgttccgcattttgaatttacggtcatgaacaatgaaaaattcctactcgcaaaggcgtgggacaaccgcatcggctgtgcgattgcaattgatgtgttaagaaacttacaaaacacagaccatccaaatatagtgtatggcgtcggaaccgtgcaggaggaagttgggctgaggggagcgaaaacggctgcacacaccattcagcctgatattgcgtttggtgttgatgtagggatagcaggagacacgcctggcatttccgagaaggaagcgcagagcaaaatgggcaaaggcccgcagattatcgtttacgatgcatccatggtctctcacaaaggtttgcgtgatgcagttgtggcaactgcagaggaagccggcattccctaccaatttgatgccattgccggcggcggaactgattcgggtgccatccatttgacggcaaatggcgttcctgcgctgtccattaccattgcaacccgctacattcatacgcacgcggccatgctgcatcgtgatgattatgaaaacgcggtaaagttaattacagaagtgattaagaagttagaccgaaaaacggttgacgaaattacgtaccaataaagatacggaagaatccgcctattgaggcggattctatttttttgtctgtacaaattacagcatagtgactacaataaaggggataccgaaaatttcctgaacatgacgatatacgatacgcagctcgatttgacaggaagggaggataaacaatctaatttgtaagcgctttctaatataaaggaggttgaacaaaattgaaaaagaaaaaaacatggaaacgcttcttacacttttcgagtgccgctctggctgcaggtttgatattcacttctgctgctcccgcagaggcagcattttggggtgcatccaatgagctgcttcatgacccgactatgattaaagaggggagctcatggtatgcgctcggaacagggcttactgaagaacggggactgcgggttttgaagtcttcagacgctaaaaattggaccgtacaaaaatccattttcagtacaccgctatcgtggtggtccaattatgtgccgaattatggtcaaaaccagtgggcgccggacatccaatactataacggcaagtattggctgtattattccgtttcttcttttggaagcaatacatctgccattggcctggcatcttcaacaagcatcagttcggggagctggaaggacgagggcttggtgattcgttcgacaagttcaaataattataacgccattgatccggagctgacattcgacaaggatggcaacccgtggcttgcattcggctcgttttggagcggcattaagctgactaagctcgataagagtacgatgaagcctacaggctcgctctattcgattgctgccagaccgaataatggcggggcgcttgaggctcctactcttacgtatcaaaatggctattactacttaatggtctcatttgataaatgctgtgacggggtaaacagtacgtacaaaattgcttacggaagatccaaaaacattacaggcccttatcttgataaaagcggaaaaagcatgcttgaaggcggaggcaccattttggattcgggcaatgaccaatggaaaggacctggaggccaggatattgtgaacggaaacattcttgttcgccatgcctatgatgccaatgacaacggcattccaaagcttcttatcaatgatttgaattggagctcgggctggccgtcctattgaatcaaaaagccgggctctgccccccggctttttttaaaagaaaagattgacagtataatagtcaattactataataaaattgttcgtacaaatatttatttataggtttattttctatcattagtacgtatcttttgtatttgaaagcgttttattttatgagaaaggggcagtttacatgcttcagacaaaggattatgaattctggtttgtgacaggaagccagcacctatacggggaagagacgctggaactcgtagatcagcatgctaaaagcatttgtgaggggctcagcgggatttcttccagatataaaatcactcataagcccgtcgtcacttcaccggaaaccattagagagctgttaagagaagcggagtacagtgagacatgtgctggcatcattacatggatgcacacattttcccctgcaaaaatgtggatagaaggcctttcctcttatcaaaaaccgcttatgcatttgcatacccaatataatcgcgatatcccgtggggtacgattgacatggattttatgaacagcaaccaatccgcgcatggcgatcgagagtacggttacatcaactcgagaatggggcttagccgaaaagtcattgccggctattgggatgatgaagaagtgaaaaaagaaatgtcccagtggatggatacggcggctgcattaaatgaaagcagacatattaaggttgccagatttggagataacatgcgtcatgtcgcggtaacggacggagacaaggtgggagcgcatattcaatttggctggcaggttgacggatatggcatcggggatctcgttgaagtgatggatcgcattacggacgacgaggttgacacgctttatgccgagtatgacagactatatgtgatcagtgaggaaacaaaacgtgacgaagcaaaggtagcgtccattaaagaacaggcgaaaattgaacttggattaaccgcttttcttgagcaaggcggatacacagcgtttacgacatcgtttgaagtgctgcacggaatgaaacagctgccgggacttgccgttcagcgcctgatggagaaaggctatgggtttgccggtgaaggagattggaagacagcggcccttgtacggatgatgaaaatcatggctaaaggaaaaagaacttccttcatggaagattacacgtaccattttgaaccgggaaatgaaatgattctgggctctcacatgcttgaagtgtgtccgactgtcgctttggatcagccgaaaattgaggttcatccgctttcgattggcggcaaagaggaccctgcgcgttttgtatttaacggcatcagcggttctgcgattcaagctagcattgttgatattggcgggcgtttccgccttgtgctgaatgaagtcaacggccaggaaattgaaaaagacatgccgaatttaccggttgcccgtgttctctggaagccggagccgtcattgaaaacagcagcggaggcatggattttagccggcggtgcacaccatacctgcctgtcttatgaactgacagcggagcaaatgcttgattgggcggaaatggcggggatcgaaagtgttctcatttcccgtgatacgacaattcataaactgaaacacgagttaaaatggaacgaggcgctttaccggcttcaaaagtagagggggatgtcacatggcttacacaataggggttgattttggaactttatcaggaagagcagtgctcgttcatgtccaaacaggggaggaacttgcggctgctgtaaaagaatacaggcatgctgtcattgataccgtccttccaaaaacgggtcaaaagctgccgcgtgactgggcgctgcagcaccctgctgattacctcgaagtcttggaaacaaccattccgtctttactcgaacagacgggcgttgacccgaaagacattatcgggattggaattgatttcacggcatgtacgatccttcctattgacagcagcgggcagccgttatgcatgctgcctgaatatgaagaggagccgcacagctatgtgaagctctggaagcatcatgcggcccaaaaacatgctgatcggctcaatcaaatcgcggaagaagaaggagaggcttttttacagcggtacggaggaaaaatttcatcagaatggatgattccaaaggtcatgcaaattgccgaggaagcgcctcacatttatgaagcggctgaccggatcatcgaggctgcagactggatcgtgtaccagctgtgcggctcgctcaagcgaagcaattgtaccgcagggtataaagcgatgtggagtgaaaaagcggggtatccgtcagataatttctttgagaaattaaatccttcaatgaaaacgattacaaaggacaaattgtcaggttctattcattcagtaggagaaaaagccggcagtctgactgaaaaaatggcaaagctgacagggcttctcccgggaacggctgttgcggttgccaatgtggacgctcatgtttcggtaccggcggtcggcattacagagccagggaaaatgctgatgattatgggaacctcgacgtgccatgttctacttggtgaagaggtgcatatcgttccaggaatgtgcggcgttgtggacaacggaattctcccgggctatgcgggatatgaagccgggcagtcctgtgtcggcgatcattttgactggtttgtgaaaacatgtgtcccgccagcttatcaagaggaagcaaaggaaaaaaacattggcgttcatgagctgctgagtgagaaagcaaaccatcaagcgcctggtgaaagcggcctgcttgctttagattggtggaatggaaaccgttcaactcttgttgatgcagatttaacagggatgctgcttggcatgacactgctgacgaagcctgaagagatttatagagcgttagttgaagcgacagcttacggaacccggatgattatcgaaacattcaaagaaagcggtgttccgattgaggaactgttcgcagccggcggaatagctgagaaaaacccgtttgtcatgcagatttatgcggatgtgacaaacatggacattaaaatctctggttcaccgcaagcaccagccttaggatctgccattttcggcgcgcttgcagcaggcaaagaaaaaggcggctacgatgacatcaaagaggcagcggcgaacatgggaaaactgaaagatataacttatacgccaaatgccgaaaacgccgcggtttatgaaaaattgtacgctgaatataaagagctggttcattatttcggaaaagaaaaccatgtcatgaaacgtctgaaaacgatcaaaaatcttcaattttcatctgccgccaaaaagaattgataaagggtgatggagcatgcttgaaacattaaaaaaagaagtgctggctgccaacctgaagcttcaagagcatcagctggtaacctttacgtggggaaatgtcagcggcattgaccgtgaaaaagaaagaattgtcatcaaacctagcggagtcgaatacagcgacctgacagccgatgacttggttgttttgaaccttgatggagaggtcgtcgaaggctcgcttaagccttcttcagatacacctacccatgtttatttatataaagcctttccgaatatcggggggattgtccatacccattctcaatgggcgacaagctgggcacaatcgggcagagacatccctccgttaggcacgacccatgctgattattttgacagtgcgattccatgtactcgagaaatgtatgatgaagaaatcattcatgactacgaactgaatacaggaaaagtcatagcggaaacctttcagcatcataactacgaacaggtgccgggtgtgctcgtgaataatcacggaccgttctgctggggcactgacgccttaaatgccattcataacgcagttgtattagaaacggttgccgaaatggcctatcactccattatgctgaacaaggatgtaaccccaatcaatacagttctgcatgaaaagcatttttatcgaaaacacggagcaaatgcgtattatggccagtcatgatacgcctgtgtcaccggccggcattctgattgacttggacggtactgtattcagaggaaatgagttgatcgaaggagcaagagaagcgatcaaaacgcttaggagaatgggaaagaaaatcgtctttttaagcaaccgggggaatatctcccgtgccatgtgcagaaaaaaacttctcggcgcggggattgaaacggacgtaaacgacattgttctgtcatcaagcgtgacagcggcttttctgaaaaaacattatcgtttttcaaaggtatgggtgcttggggaacaaggcttggttgacgagctgaggctggccggtgtgcagaacgcgaacgaaccgaaggaagcggattggctcgtgatctcccttcatgaaacgctcacgtacgacgatttaaatcaagcctttcaagcggctgccggcggcgctcgtattatcgctacaaacaaagaccgctcttttccgaacgaagacggaaatgccattgatgtggctggaatgattggggcgatagaggcttccgcacaagcgaagactgaacttgttgtcggaaaaccgtcatggctgatggcggaggctgcctgtacagcaatggggctatccgcacatgaatgcatgattataggagacagcattgaatctgacattgcgatggggaagctttatggcatgaaaagcgccttagtgcttactggttctgcgaaacagggcgaacagcgtttgtacacaccggattatgtgctggattctattaaggatgtaaccaaattggctgaggaggggattctaatatgaatcgtatcgcagctgacgttcagcgtgcttttgaacacgccggagaaaagacgttgcctataaaagttgaagaaattgttctcggtaaacaagcagctgattcgcttttggattatgtaaaacgaaaaaacaataaacatattgtccttgtctgcgacgcgaatacacaccgcattgcaggaattgatctggaaaatcagctgaatcaagaaggatttcaggccgagtgcctgatcattccagaaaatgaagccggagatgtgacagctgatgaacgatcgctcattcatgtgctgatccatacgaaacaaacaacggatgtcatgatcgcagtcggttcgggcacgattcatgatatcgtccgcttttctgcgtttcaaagagatttgccgtttatttcttatccgactgctccatctgtagacggttttacatcagcaggggcgccgattattttatacggtacgaaaacaaccattcaaacgaaggccccgtctgcactgttcgctgatctggatctattaaaagcggcaccgcagtcaatggtggcggctggctttggtgacatgctcggtaaaatcacgtctttagcagattgggaaatatcccggcatcttgccggtgagccttattcgcctgcaggagctaagatcgttcaggaggcgcttgctgcctgcattgaacacacagaagacattgcgatgaaaacggaaactggcatacgggttttgatagagtctttacttgtatcggggcttgtcatgctggcattagatcattcccgaccggcatcaggcggcgagcatcatatttcacattggattgaaatggagttaatggagaaaaaacggcctcagattcttcatggggcaaaggtgggctgtgccgctgttttattaactgacacatacagaaagctcgctcaggatgacgggctgaacgaattttcaccaagccgccgggaagccatccaatcggcttatcaaacactcccgaaaggagaagtgctggctgattggctgagatcagccggaggccctgcgtattttgacgaaatcggtgtcgggcaggattccgtcaagaatgccttcagacacgcgcacaccttaagagaccgctgcaccggattaagaatcattaatgaaaacaaaacgctgatcaaccatggtctatatgaatagcccgcacctcgaatggaaggggtaacgcagatgaaaaaaatgactgtctgttttcttgtgctcatgatgttgctgacattactcattgccgggtgttcagcagaaagatcatccgggaagtcgggtgaaaccgagctgaccttttggacatttaacgggcttcatgagcagttctatgtagaaatggtgaaggaatggaatgaaaaatatcctgaccgcaaaattaagctgaatacggtcgtttatccgtatggacaaatgcacgataacttgtctatctccttaattgcaggagaaggcgtccctgatattgccgatgtcgaattggcccgtttttcaaactttttgaagggctctgacataccgcttgccgacttgactccgctgattgaaaaggaccgcgataaattcgttgaggcgcggctgaccctgtacagcaaaaacggcaagctttacggactcgatacgcatgtaggaacaacagtcatgttttataacatggatgttatgaagaaagccggcgtcaatcctgacgatattaaaacatgggatgattaccataaagccggacagaaagtgcgcaaagtgaccgggaagccgatgggaacggtggaaacaaatgattccggaacgttcttatctatgatttcacagcaaaactcaggctattttgataaaaacggcaagctgatcctcaataatgacaccaacgtaaaaacacttcaatatttaaaagacatgatcaatgataaaacgatgattcctgcgccgggcggcgggcatcacagtgaagaatactacggctttatgaaccaaggaggagctgcttcagtcctcatgccgatttggtatatgggaagatttatcgattatatgcctgatctgaaagggaagattgccatcagaccgctcccggcatggaaagagggaggcgaccgctcggcaggtttgggcggtacggcaaccgttgtgccgaagcaagccaagcatgttgagttagcaacagagtttttagcctttgcgaagggctctaaagaaggaaacaaaaagctctggagcgtactcggctttgacccgcttcgctgggatgtctggagctccaaggaattgaaagagaaaaacaaatacacggattacttccaaaacggaacaggcattttttccgtgctgctcgatatcaaggatgaaatcaatccgatttatttacatgaggattttgccaaggcttcagaccttgtcaacagaagcgtgttgttcgacgcacttaaatctcagcaaaaaacgcctaaacaagccttggacagagcggcaggtgaactgaaacagaaatagaatcccattcaaaaagtgaaagcggggaggttctcatgaaacctgtgaaaacaggaacggttcatcccgttccttcagctgcgaaacaatcaggctggcgagatctattttattcaaaaaaagcggcgccctatctgtttacagcgccattcgttttatcctttctcgtattttttctataccccatcattagtgtcttcatcatgagcttccaaagaattttgccgggagaggtgtcctttgtcggattgtctaattatacagcgctaaacaacccgacgttctataccgccctttggaatacgctggaatacaccttttggacgctgatcgtgctgattcctgtcccattgcttctggccatattcctgaattctaagctggtcaaatttagaaatatatttaaatcagcactattcatcccggcattgacctccaccattgtcgcggggatcatttttcggctgatcttcggagaaatggaaacgtctctggccaattccatcctactcaaactcggcttttcacctcagaactggatgaacaatgaacataccggcatgtttttgatggtgctgcttgcttcatggagatggatgggaatcaacatcctttactttttagctggtttgcaaaatgtgccgaaagagctgtacgaagccgctgatatagacggcgcgaatacaatgaaaaaatttctgcacatcacgctgccgtttctcaagcctgtaaccgtatatgtgctgaccatcagcatcatcggcggcttcaggatgtttgaggaaagctacgtcctttggcagaataattccccgggtaatattggtctgacgcttgtcggatatttgtatcagcagggacttgcctacaacgaaatggggtacggagcagccatcggcatcgtgcttttgattgtgatccttgttgtcagcctgatttcattaaagctgtcaggctcgtttaagggggagggataaatgttgcggcacagtcctcagtttagcgtttatagaattgcgctaaccctgttttttattatgctgagcctattgtatctttttccgattttctgtttgcttttaggatcattaaagccgtcatctgagcttttgcgtgtggggctgaatcttgaaattgatccaaaagtgatgagttttgataactacacatttctgtttaatggcggcagcatttatttcaaatggttttttaacagtcttgtactcggactttttacgaccgtgctcactctgtttttttcttcgatgatcgggtacgggcttgcggtttatgattttaagggcagaaatatcatctttgttcttgtgctgattatcatgatggttccgctggaagtgatgatgcttcctttgtttaagcttactgtcggactgcacttgatcgattcatatacaggtgtcatattgccgtttatcgtttcacctgttgccgttttctttttcaggcaatatgctcttggccttccaagagatctgctggactctgcaaggatggacggctgtacggaattcggcatctttttcaggattatggcaccgctgatgaaaccggctttcggcgcgatgattatccttcagtccttaaacagctggaacaacttcttatggccgctgattgtgcttcggtcgaaagaaatgtttacgcttccaatagggctgtccagcttgctgagcccttatggcaacaactatgacatgcttatatccggctcagtatttgcgattttgccggtgattatcattttcttgtttttccaaaagtactttatctccggcctgacggtagggggagtcaaaggttaatgaaggaggaaacgtgtgatgaaaaaagcgcgaatgattgtagacaaagaatataaaatcggtgaagtagataaacggatttatggctcgtttatcgaacatatgggtcgtgcggtatatgaaggcatatacgagcctgatcaccctgaagcggatgaagatggatttagaaaagatgtccagtcgctgatcaaagaattacaggttcccatcatccgctatccgggcggaaactttttatccggatacaactgggaggacggtgtcggaccagtcgaaaaccgcccgagacggcttgacttggcatggcaaacgacagaaaccaatgaagtgggaacaaatgaatttttatcttgggcaaaaaaggtgaacactgaggtcaatatggccgtcaaccttggcacaagaggcatagatgccgcccgtaatctcgttgaatattgcaaccatccgaaaggctcttactggagtgatttaagaagatcgcatggctatgaacagccgtatggcatcaaaacatggtgcttaggaaacgaaatggatggaccgtggcagatcggccacaaaacagctgatgaatacggacggcttgctgcagagacagcaaaggtcatgaagtgggttgacccatcaattgaactcgttgcctgcggcagctcaaacagcggcatgccgacctttatcgattgggaagcgaaggtgcttgagcatacgtatgagcatgtcgactatatctctcttcacacttactacggaaaccgggataacaatctgccaaactacttggcacgttctatggatttggatcattttatcaaatcagtcgctgcgacctgtgactatgtaaaagcaaaaacacgcagcaagaaaacaatcaatctttctctggatgaatggaacgtctggtaccactcaaatgaggctgataaaaaagtcgagccgtggatcactgcgcgtccgattttggaggatatttacaattttgaagatgccttattagtcggctctctgctcattacgatgctgcagcacgcagaccgtgtgaaaattgcgtgtcttgcacagcttgtcaatgtcatcgcgccgatcatgacggaaaaaggcggagaagcatggagacagccgattttctacccatacatgcatgcttctgtttacggaaggggcgagtcactgaaaccgcttatttcttctcctaagtacgattgttctgatttcactgatgtgccatatgttgatgctgctgttgtgtactctgaagaggaagaaacactcactatttttgcggtaaacaaggctgaggatcagatggagacggagatttcgctcagaggctttgaatcttaccaaatcgcagagcacatcgtacttgagcatcaggatatcaaagcaacaaaccagtataacagaaaaaatgtcgttccgcattccaacggatcatcgtctgtcagcgaaaacggcttaactgctcatttcacgccgctttcctggaatgtgatccgcctgaaaaaacagtcataagaataagcaaagccggagagaaatctccggcttgtctttcaactgccacgagccggcccgttcaagccggctttttgtataggaaaaaatgaccgcttttcaccataaaattatgatatatttatgaaaaacagcaaaggggatgggagaaaatgaatgcggttacaattgtgatagcatcaatgtgtattttggctattgcctatcgtttatacggaacatttatgatggtgaaggtgctcaaagtgaatgatgacaagccaacacctgctcatgcgcttgaggatgggaaagactatgtgcctacaaataaatgggtttcgttcggccaccactttgccgcgatcgcagcggccgggccgctggtcggaccaattctggcggcgcagtttggctatttgccgggattattgtggctgttaatcggggcggtaattgggggagccgtccatgatattgtggtgttgtttgcatcgatgcgcaaaaacggaaaatcgctgtcggaagtggcgaaggatgagcttggccctgttgcaggattttgtacaggactgtccatgctgtttatcatcacgatcacaatggcgggcctgtcgatggttgtcttgcatgcgcttgaacgtaatccatggggaacatttgcggtagggattacgattccgattgcgatgggtgtgggcttattttataagaaaacgggaaatttaaagctcgcttcaacggttggctttctctttttaatggcaggagtctttattggtccatgggtacagactaccgcgctcggtgactttttaacgctagatacgaaaacgcttgcaatcgcgcttcctgtttacgcgttttttgcggctgcgcttcccgtttggctgcttcttgctccgcgtgattatttaagcagctttatgaaaatcggtgtttttatcgctttgattgttggtgtgtttgtcgtcaatccgtccattccgttccctgcgtttacagaattcgtaaaaggcggcgggccggtgctggcagggcctgtctggccgttcatctcaataaccatcgcctgcggggcgatctctgggttccatgcctttgtcggctcaggaacgacaccgaaaatgctgaataaatggagtgatatgaagccggttgcgtttggcgcaatgcttgttgagtgtcttgtcggcatcatggcgctgattgcagcgaccgctttacagcctgctgattactttgcgattaacagcacgcctgaggttttccgtacgcttggcatgaatgtcgtacatttgcctgaattgagcagggaaatcggtttggacttagaaggaagaacagggggagccgtcacgcttgcggtggggatgacttatatttttaccggaatgccgtttttcagccatttggcctcatactttttccaatttgtcattatgtttgaagcggtctttattttaacagcgattgacgccggcacacgtgtcgcccgttatttgattcaggacttcttcggggaggtgtataagccgctgaagaaaacagactggattccgggatctgtatttgccagcgcgcttgcctgtttgatgtgggggtacttgctgtattcaggagatatcggttccatttgggcgctgttcggcgtttctaatcagctgatggcttcagtggggctgattatcggagcgacgatcgtgctgaaaatcgccgataaacgccggtacattctgacctgtcttatcccgcttgcctatttatatgtcactgtcaattatgcgggctattggatggtgcgcaatgtgtatctcaatcctgaagcagcaggatatagtgtattgaatggcgtattatctatcatcatgctggtgttaggcttcatcattattgtggcggctgtgaaaaaatgggcgcagatgtggaaagatccgagcttaaggatggaagcatctataccgggctagaaggactattgaaaatgctgaggggggggttggcaatgaatctatcaatgaaatatcttattctatatgtatcggacagcaagcgggctattcatttttaccgggatattttaggactgccgattcgtgctgaacacggcacgtatgtcgaatttgatacagggtctacgatattggcgtttaatacgcgggaaagcgccagagacatcacggcgctggacattccggatacatctgcttcaaacacatttgaaatcgggtttgttactgaaaatgtagaagcggtcatcaaaaggatgagagaacaaggcgtatcgattatcggggagccgaaagtgaaaccatgggggcagacggtcgcctatatcgctgatccggatggacattatatcgaaatttgcagtccgatggaataacgcacaaaagcccaaaacaatatctgttttgggctttctcatgatgttttgtgcccggctgcttccaatagcaaatcagccaggtgaacggctctgactttaccgcttagtccttcgcgttcaatgccgagcttcatttgcagcaggcagccgggatttgctgttacaatgaggattgcttcggttgctttgacggcagccattttactgtccagtattctcatagacatttcagcttcgacgatgttgtaaattcccgctgacccgcagcagctgtctgctttctccatttctttgaattccgcccctttgatgcttttaagaagctggcggggctcgagtgacgtatgcatcacatttcttagatgacatgaatcttggtaggtaacgacctgaggcgtctcgagtgctagatccatttgatggaaatcgagttcaaccaaaacagaagaaaaatccttcagcttttgaacaaaagcggcagcccgttccgaccactcagggtcatccttcagcaaatgatcatattcagtgagaaaggctccgcatcctcctgcgtttgtaatgactgcatccacgtctaatgcttcgaaagcagcgatattttgtttcgcgagctctttccctgtgtttttttcaccgctgtgtccatgaagcgccccgcagcaagcctgttcaggcggaatgacaatgtcgcagcctgccagctgtaaaagcttcaatgtggcgttattggtcggtaaaaacattgtatccattaagcagcccgaaaaaaaggcgacccgttttttcatggggccaatggaaggcaggaaacgcggccgatgtttcatgtctttgctttttggaacatcaggaagaacagcttccatcgtccgcaaatgctcaggcaggacccgaagcatgcctgattttcgcacagcggtttgcagtcctgaacgctgatacaaaccgataaggcttacagctgagcgcatgcggttttgatgcggaaacagctcgtgaaaagccgtctttcgcatgacacgttcaccaagagagtgttttttattttggtggataatatctctggcttcctcaagcagctgcccgtatttcacgccagacgggcatacaggctcacaggcgcggcagacgaggcaaagtgacagcgaccgttcgacatcttcatccggttcaatcataccgtcggctacggctttcattaaggcgatgcgcccacgcggagagtgtgtttcctgaaatcccgattcgatataggtcggacaggaaggaagacagaagccgcagcgcatacaatttaataactctccttcatccatacgctctttaaattcattttggatctgtttcatttctttttctgttgtcatctttccgccaccacacgttttctggcatctttcgcaaacattttgccgggatttaatatgttccgggggtcaaatgccgctttcaacgctttcatcgcatcaatgccttcttttttcagcttcatttccaagtaaggcgctttcatttccccgactccgtgctctccggttatcgtcccgccaagttcaatcgctttctcaaaaatctcggcaaaagcctgttcgacacgttccatttcatccttatttcttatgtctgtcgtgcatgtcgggtgaaggttcccgtctcccgcatgaccaaaggtgcagatggaaatatcatatttagcagcaatatcattaatcgctttaaccatattggcgatttctgagcgaggaacggtcgcatcctctaaaatcgtcgtcggtttgaggcgggctagggcagaaagtgcagaacgccgggcttcagtcagggcaaacgcttcctcctctgtttgtgcggtctgaacggatacggcgtcgccttttttgcagatcgcctcaatcttttccatatcccgttcaacagtttcaaatggcccgtcttgttcaattaacagaactgcttttgcgcttgtcggaagtccgattttggcataatcctcaatcaccaatagtgtaggctgatcgagaaattcaagcgtagcgggtataatttttgcggcaataatgtccgataccgtttgagcagcggcatcgatgttttcataaagggcaagcagcgtcttctttgtttccggctttggaacgagtttgacgattgcctctgtcacaatgccgagtgttccttctgagccgacaaaaagacgtgtgagatcgtatccggccacatcctttgcgagttttccgccggtgcggatgatgtcaccatttgcgagcacaacctccagtccaataacatagtcgcgggtgacgccgtattttaatccgcggagcccgccggaattttcattgatgtttccgcccatggttgatattttcatagaactcgggtcaggcggataaaacaagcctttgctttcaaccgcgcggatcatatccagcgtaatgacgcccggctgaactgtggcagttaaattttcttcatcaatttcaagaatctggttcatgtgcttaaagagaagcacaagtccgccttcagtcgggcacgtgccgccgcacaggtttgtccctgatcctcttggaacgatcggcactcgatgttcgctgcaaattgttaaaatgcgtgatatttcatcagtattcctcggagcaatcacggcatcaggcatagactgatactgaggcgtcgcatcatatgaatagacgagacggccggcattcgagtcatcaaagttttctggtccggagacctgaatcagctgctcctttacatccttggtgatcatttcacccaccccctgtcaaaaaacgctttcaatctattgtaaaagaaaaaaagcaaagccttccatggagaaacatacaaaaaatgaaactgaaactctctctattttgtatcttgatctaaaaaatagagtgcgacgtacatcgtgacgacgtcctcggtacggtcaaaacgtaatcccgtcagctgttcagccttagccagacgataacgcaatgtattgatgtgtatatgcatgtcttcagcggtttgtttcaaagacaaatcgtgatgaaagaaagtccgtatcgtattcataagttcctgatgctctagcgcctttcctaatactctttgcggaaattcgtttcgggttcccgggctgatctccgtcagacacatatcaagcttcagatcctcttcaaatatgggcgtttttcgcttaaggctgacagccagcgctttttccgcttgctcgtatgaatctgtcaggctggagcttgcgacagcccttccggcgccagctgctgtatattggctgcttgcggtattggcaaacgaacaaatgtgaaggatcttccgtaaaagctgatccctttgttcatgctgcggcacttcatgattaatcaaaatccgttcatttccccacctgatgaacaaatccgcagggtacgatgatttccagatgcgtgccatttgttcaatatcatgacgtgaccactcatactcctgaataagaatcatttggcgccgggaagaaaggtcaacaccaagaagctgagctttctcaagaaaactgggagaccactcctttaattgcagccaatcgatcataaaggactccagcattctctcacgccactgggattgctctaagtgccgcgattccttaatgaacagttctgtcatttttcgaagcagttctccgaatggctgaatctctgcaggctcacctgtcagcccgaagacggcaatcacatcatggtcaaaaaatacagggaggtttatgcctgctttcactccttttaaccttgtttcatcttctcttgtaataatcacgctgcgtctttcttttgcgcagataagcgctccctcatgaaattgtccgacacgctcatcgtttgtgcctgccataataagaccgtccgtgtttacaataatgacttcacgttcgtacatttttttaacttcagcaataatttttttcgctaataacggctgtaaaaacatggcgttccccctcatcatgtttttattatataagaaaaaaaccgggcgctgtcacccggtttcatgtcttattcggctggttttaatccgccttcaagcgttttcagcatttcgtttttctcactttcggatgcgtgctgccaaatgacttcgaataaaacgccgagccctggaagcattttttcttcaccgctttgaatcgcatctacgattgtatgctcaagctgctcctgattattgccggtgacattggcaatgacggcatgacgtaaattaagatccatgtaaaacgctcctttttctaaaatgtaatacgtatattctaaccctgcacctggtttattatgtgctgttcttgcgatataataacatcatgttaaaaaaaggagcgccacatagacagtgaaacaaatagaatcggcaaaaaaccaaaaagtgaaggattggaaaaagcttcacacaaaaaaagaacgaacaaaaacaaatacatttctgatagagggagaacacctcgttgaagaggcgttgaaaagcccgggcattgtgaaagaaatccttgtaaaggatgaaacgaggattccttcagatcttgagactggtatccagtgctatatgctgagtgaagatgcgttttcagctgtgactgaaaccgaaacgccgcagcagattgccgctgtgtgccatatgcctgaagaaaagctggcaacggcacgcaaggtgctgctgattgacgctgttcaagatccgggaaaccttggcacaatgattcgaacggctgatgcggccggtttggatgcggttgtactcggtgacggcacggcggacgcctttaacggaaaaacactgcgatctgctcaaggatctcacttccatattcctgttgtgagaagaaacctgccttcatatgtggacgaattgaaggcagagggcgtaaaagtatacggcacggcgctgcaaaacggagcgccttaccaggagattcctcagtctgaatcctttgcgctcattgtaggaaatgaaggtgcaggggtggatgctgcattgctggaaaaaacggatttgaacctgtacgtgccgctttacggacaggctgaatcactaaacgttgcggttgcggctgccatcctcgtgtatcacttgcgaggatagtgttgcgccaagcgttggatttctctataatagaacataatatttcaaaaaccgtgacagaggacctcaatttctgatcaactgctttccagggagaaaatgccgctgactgagagcatttttaacgcagccggaaattggcttcacctcttgagttgtcgccgggaccgcgtacactgcgcgtaaaggtgaaccggaatctgattccgttatgtcaatgaagctgacgacagcatcagtctgtctgaaataagggtggtaccgcggccacaactcgtcccttgtacaagggacgggttttttttattttccaaagacatatgacggtttgtttacataaaaggaggatgcaaaatggaagaaaagctaaaacagctggaacaagaagctttagaacaagtagaagcggcaagctcattgaaggttgtcaatgatattcgggtgcaatatctcggaaaaaaagggccgattacagaagtgctgcgcggaatgggcaagctttctgctgaggaacgtccaaaaatgggggcgctcgcgaacgaagtaagggagcgtattgccaatgcgattgctgacaaaaacgagaagcttgaagaagaggaaatgaaacagaagcttgcaggacagacaattgacgtcacgctgccggggaaccctgttgcagtcggtggccgccatccgctcactgttgtcattgaagaaattgaagatttatttatcggtatgggctacacagtcgaggaagggccagaggttgaaacggattactacaacttcgaatcgctcaatcttccgaaagaacaccctgcgcgcgatatgcaggacagcttttacatcacagaggaaactttgatgagaacgcaaacttctcctgtccaaacacggacgatggaaaagcataaaggcaaaggtcccgttaaaatcatttgcccgggtaaagtatatcgccgtgataacgatgatgcgacgcactctcaccaatttatgcaaattgaagggcttgtcgttgacaaaaacatcagcatgagtgatttaaaaggaacgcttgaactcgttgcgaaaaaaatgttcgggcaagaccgtgaaatcagactccgcccaagcttcttcccgtttactgagccttcagtagaagtggatgtgacatgctttaaatgcggtggaaacggctgctcagtatgtaaaggaacaggctggatcgaaatcctcggcgccggcatggttcacccgaatgtgcttaaaatggctggctttgacccgaaggaatatcagggcttcgcattcggaatgggtgttgagcgcatcgcgatgctgaaatacggcattgatgatatccgccacttctatacaaacgatgtcagatttatttcgcagtttaaacaggcgtaagaggaggatgcaaggatgtttgtttcttataaatggttagaggattatgttgatttaaaaggcatggacccggctgttcttgctgaaaaaattacaagagccggtattgaggttgaaggaattgaatacaaaggagaaggcatcaagggcgttgtcatcggccatgtgctggagcgcgagcagcatccgaatgctgataaactgaataagtgccttgtggatattggagcggaagcccctgtacaaatcatttgcggcgcgccgaatgtggataaaggacaaaaagtcgcggttgcaacagtcggagcggtgctgccgggcaatttcaaaatcaaaaaagccaagcttcgcggtgaagaatcaaacggcatgatctgttccttacaggagcttggtatcgaaagcaaacttgtggcgaaggagtatgcagaaggcattttcgtattcccgaatgacgctgaaacaggaagcgatgccttagcggctttacagcttgacgatgcgattcttgagctgggtttaacgccaaaccgcgcggatgccatgaacatgcttggtgttgcttacgaggttgccgcgattttagacactgaggtaaagcttccgcaaacggattacccggctgcttcagaacaagcgtctgattacatttcagtcaaaattgaagatcaagaagcgaacccgctgtacactgcaaaaatcattaaaaatgtcacgattgctccgtcaccgctttggatgcagacaaagctgatgaatgcaggcattcgtccgcacaacaacgtcgttgacatcacaaattttgtcctgttggaatacggacagccgcttcatgcgtttgattatgacagatttggctctaaggaagtcgtagtaagaaaagcagctgagaatgaaatgatcgtcactcttgatgatcaagaacgtaagctgtccgccgatcaccttgttattacaaacggaatgaaagcgcaggccgttgcgggtgtcatgggaggagcagagtcagaggttcaggaagatactaaaacgattttgcttgaggctgcgtatttcaacgggcagacggttcgcaaggcttccaaagaccttggtttgagaagtgaatcaagcgtaagatttgaaaaaggaattgatccggcgcgcgtacgtcttgcagcagaacgggctgcgcagatgatccatctgtatgccggcggtgaggtgcttgctggaacagttgaggaagatcacctgacaatcgaagcaaataacattcacgtatctgctgacaaagtgagcagcgttctaggcctgacgatcagtaaagaagaactgatcagcatttataaacgtctcggttttacggtcggtgaagcggatgaacttctcgttgtgactgtcccatcacgccgcggcgacattacaatagaagaggatttaattgaagaagcggcaagactgtacggctacgataacattccgtctacgcttcctgagacagcgggaactacaggcggattaacgccatatcaggcaaaacgccgtaaagtcagacgcttccttgaaggcgcaggcttatcacaggccatcacttactcactgacaaacgagaagaaagcggcagcgtttgcgattgaaaaatcactgaatactgtgcttgcgcttccaatgagtgaagaaagaagcattctcagacacagtcttgtcccgaatctgcttgattctgtttcttacaaccttgcgaggcagactgactcagttgcactgtacgaagttggctccgttttcctaacgaaggaagaggacacaaaacctgttgaaacagaacgcgtagcaggagctgttaccggattatggcgcaagcagctatggcagggtgaaaagaaaccagttgatttctttgttgtcaaaggaattgtggaagggcttttagacaaactcaacgtcctagacagcattgaatttgtacagtctgaacgcaaacagctgcatccgggcagaacagcgaacattttattgaatggttctctgatcggcttcatcggccaagtccacccttcattggaaaaagaactggatataaaggaaacatacgtatttgagctcgatcttcatgcgttgctcgcagcagaaacagcaccgcttgtttacacggcgattccgaaatatccgtctgtgacacgtgatatcgcccttgtaacagataaaaccgttacaagcggacagctcgagagcgtcattaaagaggctggcggcaagcttctgaaagaggtaaccgtctttgacgtatacgaaggcgaacatatggaggaaggcaagaagtcagtcgctttctcactccagtatgtcaaccctgaacaaacactgactgaagaagaagtgacaaaggcgcacagcaaagtgctgaaagcgttagaagacacatatcaagctgttttaagaggctgagaaaaaagcttgcagagaaatctgcaagcttttttctatgagcgttttttatcagcaaggcgctgcgctttttgcgtattggcgaaatggagttttgtaaaggttctgagtgcagatgccccttttttgaggatcagcttggcggccgcttcatcgacgtgcggaccggctcctttcggaagtgtcattcctgcctcgcgtgacagtttatccatttccattaaaaatgaatatcttgcaatgattgaagcagcggcgacagccaggtgaataccttcagcttttgtgctaaaataggtccgctccttcacaatgtctctgccctttaaatgattgaagtagacgcctggctcagcgaattggtcaatcaaaatggcctcaggctttattccatccattttccttaataaatgggtgatcgcctgattgtgcagcaatgctttcattttcccttggctcatgcctttttcctgcatgctgttatacttttcattttttaaaaccagcaggctatatggaatagttttgatcaggtttcgggcaatctcgatgatttgcggatcttttaaatctttagaatccttaacaccgagttccttcattaaaggaagcatggttttgtcgacgtacgcgcatacaaccgtcattgggccaaagtaatctccggttccgacttcgtcagaaccgataacagacattccggcgatatctgccggaggggcatagcggggatcagccggctttttggccattttcttcttttccggctctgctgttccccagcgcgcggattctgccgctgcgtttttgccttgaaacaagaccttgccggattgatatgctgtaatggtacagccgggcggtttcgcctgaaaaacggctccctgcggaacagaggctgtaagcgaaccgctgtatgtcattttcatttggtcaatagcagacaacgatacttttatcactgaatgggacacgtaataatctcctttttttacacttttcgctgtatataccagtgtatcataacagcgggaggctcgtctttccattcatttaataaacgtgttatgataagaactaggattctcgcggaatggaggagaaacgttgtctgacggcaaaaaaacaaaaacaaccgttgacatttacggccagcacttcacgattgtcggtgaagaaagcagagcccatatgaggtatgtcgccggaattgttgatgataaaatgagagaaatcaatgaaaaaaatccataccttgatataaataaacttgcagtgctgacagcggtaaatgtggtgcacgattatgtcaaattacaagagaaatgtgaaaaactggagcgtcagcttaaagaaaaggattgaacaactatgctagatatcatcatcttaatcttgctcctgatggggactttactggggttaaaacgcggttttatcctgcagtttatccgcttgacgagctttattttatcaattgcctttgcggctttattctataaaaacgtggcaccgcatttacattggattcccgcacccgatttttcagcgggacagccggctctttctttttttacggggaatttggaagcagcgtactataatgcgattgcgtttatcgttttatttatcattgctaaaatcttactgagaatcatcggctcgttcctgagtattgtagccggcattccggtgattaaacaaatcaaccagatgctgggagccgttctcggttttctagaagtctatttatttacatttgtgctgctgtatgtcgcatccgttctgccggtagacgcgttgcagcaaatgatggggcaatcgtctctcgcaaatgtgatcattaaccatacaccgtacttgtcagggcttttacaagagctgtggacacagtacggggcataaaaaaacttctcttgtccggagaagtttttttcaagtatgatggaaacatatgtgaacgtctgggggttatgatatgcataaaaaagatattatccggctgcttgaaaccattgcagtctatatggaactcaaaggggacaacccgtttaaagtatccgccttccgaaaagcggcggcagctctggaacaggacgaccgaagcttatcagaaatggacgatatgatgtcgctgtccggcattggaaaaggaacgtacagcgtcattaaagagtatatagatgaaggaaagtcaagcacgctcgaatcgcttcagaaagaagtgccggaaggactcgtgcctttattgaagctgccggggctcggcggcaaaaaaatcgcaaagctgtataaagagctcggcgtacacgatgcagaatctctgaaggaagcctgtgagcagcaaaaggtccagggtcttgcgggcttcggcaaaaaatcggaagaaaaaatattacaggcgctcggggaagccggaaaacagcctgaacggttcccgatcggctacgccctccggatcgcgcgggaaattgaggagcatctttctcaatttacgcatatcatcaaattttctcgtgccggaagtctccgcagagcgcgggaaacggtgaaggatctggattatatcattgctacagatcgtccggctgaagtaagagagcagcttcttgagctgccaaacatcaaaagcgtgatcgcaagcggagatacgaaggtgtccgtcatcctttcctttgaatatgaaacaagcgtcgatttccgtcttgtgacggaagagcagtttccgacaaccctccatcattttacgggatcaaaggatcacaatattaagatgcgccaaatcgccaaagaacgcggcgagcggatcagtgaatacggcgttgagacagttgaaaccggagagatcaaaacatttccgagtgaacgtgaattttatgcgcacttcggcctgccgctgattccgccggaaattcgtgaaagcggacaggaagtggaaacatacagcgacagcattgaactgatagagctcgggcaaatcaaaggtgatctccacatgcactcaacgtggagcgatggcgcattttcgatcagagagatggctgaagcctgcatcaaaaaaggctatcaatacatggcgatcaccgatcactcacaatatttaaaggtcgccaacgggcttactgcagaaagacttaagcagcaggcaaaagaaattgacgcgctgaatgaggagtttgaaaacttccgtattttgaaaggcgttgagatggatatcctgcctgacggtacgctcgattatgatgacgatgtgcttgcggaaatggatatcgttattgcatcgattcattccagttttaatcagccggaacacgtgattatgaaacggcttgagacggcactgacaaacaagcatgttgacattatcgcacacccgaccgggcgccttatcggcagacgggccggttacgaaatcgatattgatcagctgattgagcttgcgaggaaaacaaatacggcgcttgaactcaacgccaaccctgcgcgccttgatctgcgcacagagcatttaatgaaagcaaacgaacaaggggttacattggtgattaatactgatgcccataatattgagatgttagacgatatgaaaactggcgttactgccgcgcgcaaaggatggacggaaacgaaaaacgttctgaatgcccggtcgcttaaagacgtagaggcatttctgaagcgcaacgattaagtaaggaggctcacacaatcgtgcagcaaaaagtattatcagctcttgaatttcataaagtgaaagaacaggttattgggcatgccgcttcatcgctcggaaaagaaatgcttctcgagcttaagccttctgcttctatagacgaaatcaaaaaacagctggatgaagtagacgaagcttctgacattatccggctgagaggccaagcgccatttggcggccttgtagatatcagaggagcgttaagacgggcggaaatcggcagcgttctcagtccttctgaattcactgaaatctcaggcctgctttatgcagttaaacaaatgaaacattttatcacgcaaatggctgaagacggtgtcgacattccgctgatccatcagcatgctgaacagcttatcacgctgtccgatttagagcgggacattaattcctgcattgatgatcacggagaagtgcttgatcatgcatcggaaacattaagaggaatccgcacacagctcagaacactcgaatcaagagtcagagaccggttagagtcgatgctgcgttcctcttccgcatcgaaaatgctgtctgatacgattgttacgattcggaatgaccgctttgtgatcccggtcaaacaggagtacagatccagctatggaggaattgtgcacgacacctcatcctctggtgcgacactattcattgaaccgcaggcgattgtagatatgaacaattcccttcagcaggcgaaagtgaaagaaaagcaagaaattgaacggattttgcgtgtgctgacagagaaaacggcagagtatacagaggagctatttctagatttgcaagtgctgcagacgcttgactttatttttgcaaaagctagatatgcaaaagcggttaaagcgacaaaaccgattatgaacgacaccggctttatccgtttgaaaaaagcccgccatccattgcttccgcctgatcaggttgttgccaatgacatcgagcttggccgcgatttttcaaccattgtcatcacagggccaaacaccggggggaaaacagtcacccttaaaacgttaggcctgctaaccttaatggcgcagtcaggtcttcatatcccggcagatgaagggtcagaagcggcagtatttgagcacgtattcgctgatatcggtgatgaacagtcgattgagcaaagtttaagtacgttctcatcccatatggtgaatattgtcggcattttagaacaggtcaatgaaaacagccttgtgcttttcgatgaacttggtgcagggacagatccgcaggagggggcggccctcgccatgagcatcttggatgacgtgcatcgcaccaatgcacgagtgttagctacgacgcattatccggaattgaaggcgtacggctataacagagaaggcgtcatgaatgccagcgttgaatttgacatcgaaacgctgtcaccgacctataaacttttaattggtgtgccgggtcgaagcaatgctttcgaaatttcaaaacgcctcgggctcccggaccatatcatcgggcaggcgaagtcagaaatgacggccgagcataacgaagtcgatacgatgattgcgtcgctggaacaaagcaaaaaacgtgcggaagaagagctttctgagacagaatcaatcagaaaagaagcggaaaaactgcataaagagctgcagcagcaaatcatcgagcttaacagcaaaaaagacaaaatgcttgaagaggcagaacagcaggctgctgaaaaagtaaaagcggcaatgaaagaagccgaggacattattcatgaattgcgcaccataaaagaagaacacaaatccttcaaggatcacgagctgattaacgcgaagaaacggttagaaggcgctatgcctgcttttgaaaagtccaagaaaccggaaaagccgaaaacgcaaaaacgcgactttaagcctggcgacgaggtgaaagtcctcactttcgggcaaaaaggaacattgctcgaaaaaacaggcggcaatgaatggaacgttcaaatcggtattttaaagatgaaagtaaaagaaaaagatctggagtttatcaaatcagctccggagccaaaaaaagaaaaaatgattacagcggtcaaaggaaaggactatcacgtatcgcttgaacttgatcttcgcggcgaacgctatgaaaatgccctcagccgggttgaaaaatacttggatgatgcggtgttagccggatatccaagagtgtcaatcatccacggaaaaggaaccggcgctttaagaaaaggcgtacaggatcttctgaaaaaccaccgcagcgtcaaaagttcccgtttcggtgaagcaggtgagggaggatcaggcgttacggttgttgaactaaaataaaagggagtatggccatgagtgatttttgggaaaacgagcttgtggaaatcgcggcatattacagtgtcgcggttctctgcctcgtcctctttttgactgtgtttgagctggtgacggcttataaaaactgggaagagattcaaaaaggaaatcttgcggtggcaatggcgaccggcggaaaaattttgggaatcgcaaacgtatttcagcattccatctcccagcataattcgctgctgcaaatgatcggctggggcgtttacgggtttgttatgcttctgatcagctactttatttttgagtttttgactccgcggtttaaaattgatcaggaaatcgaaaatgataaccgggctgtcggctttatttcatttgtcatttctgtcgggctttcttttgtggtggcagccggaatataaggggacggagaatagatggaaaagcttgcgaaaatactgctcgtcgcagcgggaatctttttgttaattggtcttatatatctgttcatattatgagaaaaagaaagatttacctttctttttcttttttttgccgtccatctgctataatgataaggtggatctctaaaatcgaaaggggaggttttatgcagtctcaaaagccgtggcttgccgagtatcccaacgatatcccgcatgagcttccgttgccgaataaaaccctgcaatccatcctgacagactccgccgcacgattccctgataaaaccgcaatatcgttttatggaaaaaaactcacctttcatgacattctgacggatgctcttaaacttgcagcttttttgcagtgcaatggcctgcaaaaaggagacagagtggctgttatgctgcccaattgcccgcaaacagtgatttcttattatggcgtcttgtttgccggtggcatcgtggtgcagacgaatccgctttataccgagcatgagcttgaataccagcttagagatgctcaggtaagtgtaatcatcaccttagatttgcttttcccgaaggcaataaaaatgaaaacgttatcaatagtcgaccagattttgataaccagtgtaaaagactatttgccttttccgaaaaatattctttacccgctgacgcaaaaacaaaaagtgcatatcgactttgacaaaacagctaacattcacacgttcgcttccagtatgaagcaggaaaaaactgaactcctgacaatcccgaagatcgatcctgagcatgatatcgctgtcctccagtataccggaggaacaaccggagctccaaaaggggtcatgctcacgcaccaaaatattttggcaaatactgaaatgtgcgccgcttggatgtatgacgtgaaagaaggcgctgaaaaagtgctgggcatcgttccattttttcatgtctacggactgacggcagtcatgaactattcgattaaactaggcttcgaaatgattcttcttcctaagtttgatccgctcgaaacacttaaaatcatcgacaaacacaaaccgacgctctttcctggcgcaccgacaatttacattggccttttacatcaccctgaattgcagcattatgatctgtcatccattaaaagctgtcttagcggatcagccgcgctccccgtggaggtaaagcagaaatttgaaaaggtgactggcggaaagcttgtggaaggctatggtttgtctgaggcatccccagtgacgcacgccaactttatctggggaaaaaacaagccgggcagtatcggctgtccttggccgagtacggacgctgcgatctattctgaagagacgggtgagcttgccgctccgtacgagcatggagaaatcattgtaaaaggtccgcaagtcatgaaaggatactggaataaaccagaggaaaccgccgcagtgctgagagatggctggctgttcaccggggacatgggctatatggatgaagaaggctttttctatattgctgacaggaagaaggatatcatcattgccggcggttacaatatttacccgcgtgaggtagaagaagcgctttatgaacatgaagccatccaggaaattgttgtcgcaggcgttcccgattcctacagaggagaaacagtaaaagcatttgtcgtattaaagaaaggcgcaaaagccgatgcagaagaactggacgcttttgcgagatcacgtctagctccctataaggtgcccaaagcctatgagttcagaaaggagctgccgaaaacggcggtgggaaaaattttaagaaggcgtttacttgaagaagaaaccgaaaatcatcatatcaaataaaaaaagagaacgcctatgaataaacttgacaaacctgaaaatccttcttatcatgaaattatgaatgaatagtcattcatttctataggaaggaacgatgaacattgaagcaaaaacggccaaagtatatgcagattattgatgcagcagtagaagtcattgcagaaaacggctaccaccagtcacaggtatccaaaattgccaaacaagccggggtagcggacggcaccatctatctctattttaaaaacaaagaagatattttaatttctcttttcaaagaaaaaatgggtcaatttattgagcggatggaagaggacattaaagaaaaagcaacagcgaaagagaaattggcgcttgtgatttcaaagcatttttcccttttagcgggtgaccataatctcgccattgtcacgcagcttgagctccgccaatccaacttggagctgcgccaaaaaatcaacgaaatattaaaaggctacttaaatattttggatggcattttgacggaaggtatacaatcaggcgaaataaaagaaggcctcgatgtccgcctcgcccggcagatgatttttggaacgattgacgaaactgtgacaacttgggtgatgaatgaccaaaagtacgatctcgttgcgctttcaaacagcgttttagaattattggtatccggaattcacaataagtaaaggagttctgtcctatgaatgcaatttcacttgcggttgatcaatttgtggcagtcttgacgattcacaatccgccggcaaacgcgctttcaagccggatattagaagagctgtcttcctgtcttgatcaatgtgagacagatgcaggcgtacgaagcattatcattcacggcgagggaagatttttctcagccggcgctgatattaaagaatttacatcgcttaaaggcaatgaggattcctcattgctcgctgagcgcggccagcagttaatggagagaatcgaaagttttccaaaaccgattatcgcagcgattcacggcgctgctctcggaggcgggctggagcttgcaatggcctgtcacatcagaatcgcggcagaagatgctaagctggggctcccggagcttaatctcggtatcattccaggttttgcggggacacagcgccttccgagatatgtcggtacagccaaagcactggagctcatcggatcaggagaaccgatatccggaaaagaagcgcttgatctcggacttgtctcaattggagcgaaagatgaggcagaagtgattgaaaaagcaaaagcacttgccgctaagtttgcagagaaaagcccgcaaacgctggcatctttgcttgaacttctttattccaacaaggtgtattcctatgaaggcagcttaaagcttgaagcaaagcgatttggggaagcatttgagtcagaggacgccaaggaaggcatccaggcatttctcgaaaaaagaaagcctcagttcaaaggcgaataaaaggggatatgatcatgaatctatttgtactgatgaaacggacgtttgacacagaagaaaaaatcgtcattgaaacaggaaagattcaggatgacggagcggaatggatcattaatccatatgatgagtacgcgatagaagaagccatccagctgaaggaaaagcatggcggcacgatcatcgccgtcacggtcggcggtgaagaagcggagaaagaattgcgtacggcgcttgccatgggttgtgaccaagctgttttaatcaacatagaagatgatcttgaagaacccgaccaatattccatttctcaagttttataccactatatgaaggatcaggagtttgatttgattctcggcggaaatgttgccattgacggaggatcaggacaagtggcgcctcggcttgccgagctactggacattccgtgtatcactacgatcaccaaactcgaaatcaacggcactgatgcagaagcagaaagggacgtcgaaggggatgttgaaaaaatcaaaacgacgctcccattgcttgtcacagctcagcagggcttaaacgagccgcgctatccatcgcttccgggaattatgaaggctaagaaaaagccgcttgaagagcttgaacttgatgatcttgacctggacgaagaggatgctgaaccaaagctgaaaaccattgaacgttttctgccgccgaaaaaagaagccgggaagcttctccaaggtgagcctgctgaacaggcaaaagagcttgtttcattgctccgcagcgaagctaaagtcatttaaagcttggacattcaaagaaacagggggatgttagaatgggaaaaaaagtgatcgtgcttggagaaatacgcgatggggaattgcggaatgtcacctttgaagcaatagctgcaggaagaaccatttcaggagatggggaagtcatcggtgttctcatcggtgaaaatgtacaaagcattgcacaagagcttattcattacggagcagataaagtttttaccgctgaggacccgaagctgaaaacatacacggcagacgggtacagccaggtcatgagaggtgttatcgagcaagaaaatcctgattcagtcatcttcgggcatacggcaatgggcaaggatctttcaccgaagcttgctgcccggctgcaaacaggcttaatttctgatgctatagatgtaagcgttaccggagggaatgttgtgttcacacggccgatttactcggggaaagcttttgaacgcgtcatttcaaccgatccgatgatctttgcaacaattcgccccaataacattcaagcttcagaaaaagacaccagcagatcggggagcatcgaaagcattgatgtttctcttactgacctccgcactgttatcaaagaggtcgtcaaaaaaacggcggacggtgttgatctctccgaagcgaaaattatcgttgcgggcggccgaggagtcaaaagcatggaaggatttcagccgctgcaggagcttgcagaggtgctaggggccgcagtcggggcttctcgcggggcatgtgacgctgattattgcgattacgctctccaaatcgggcagaccgggaaagtcgtcactccggatttgtacattgcatgcggcatttccggcgccatccagcatttggccggcatgtcaaacagcaaggtgatcgtcgccatcaataaagaccccgaagccgatatctttaaaatagcggattacggcatcgtcggtgatttatttgaagttgtcccgttattaactgaggaattcaaacaattgaatatacactcataaaggaaatcccggactttaaaagttcgggattttttcatatttataaatacatacgtacaaatataaaaacaatagaaaatgtcgttgacatgtacgaacatatataatatggttactttaaaagcgcttacattcatgctgactcctcaggcaaaagacagatcacatatttgactgtggtgcttttcatatccgtatgaaaggaatgatcagaggcatgtctgaacatcaagcagtgattcaaacagatatcgtaaaaggaaccattaacaaaaatatatacggtcattttgccgagcatttaggaagagggatttatgaggggatctgggtcggaacggactcagacatccccaatatcaacgggatacgaaaggacgtgctggaggcgctcaaacagctgcacattcctgtcctcaggtggccgggcgggtgttttgcggacgaataccattgggcaaacggtgtcggtgaccgtaagacaatgctgaacactcactggggcggtacaattgaatcaaatgaattcggaacgcatgaatttatgatgctttgcgagctgcttgaatgcgagccatatatttgcggcaatgtcggaagcggaaccgttcaggaaatggcggagtggattgagtatatgacatttgaagaaggcacgccgatgtcagactggagaaaacaaaatggaagagaagagccttggaatctgaaatatttcggcgtgggtaatgaaaactggggctgtggcggcaacatgcatcccgaatactacgcagatctgtatcggcgttttcagacttatgtccgcaattacagcgggaatgacatttataaaattgcaggcggcgcaaatgtggatgattttaattggacggacgtgcttatgaaaaaagccgctggcctgatggacgggttgagtcttcattattacacgattccgggggatttctggaagggcaaaggatcagccacagaattcacggaagatgaatggtttattacgatgaaaaaagccaaatacatcggtgaattgattcaaaaacacggcacgattatggaccggtacgatccggagcagcgggtcgggctgattattgatgaatggggcacgtggtttgatcccgagccaggcacgaatcccggtttcttatatcagcaaaacaccattcgtgatgcactggtggcggcttctcatttccacattttccatcagcattgccgccgggtgcaaatggccaacatcgcccaaacagtaaacgttctgcaagcgatgattttgactgagggagagcggatgcttttgacaccgacgtaccatgtattcaatatgtttaaggtgcatcaggacgcttctcttttagccacagagacaatgtctgccgactatgaatggaacggtgaaacgcttccgcaaatcagcatttcagcgtcgaaacaagctgaaggcgatatcaatatcacaatttgcaacatcgatcaccaaaacaaagcagaggcggaaatcgagctgaggggcctacacaaggcagcggaccattccggagtcattcttacggcagaaaaaatgaatgcgcataacacgtttgacgatcctcatcatgtcaaaccggaatccttcagacaatacacgctcagcaaaaacaaactgaaagtaaaactcccgccaatgtcagtcgtcttacttacgctgcgtgctgattcttaatcgcgcaagagcgccggagcttcatgccggcgctctttttcaggttttaaaacagctccggcagggcatggtaaagtacatgacagtgaagaggagatgtgatcttatgcttcgtaccattttaatgattattggggcaattgtagtgatcggggccattatcagatttgtgttttaaaaaaagagcatatcccattcaaccatataaaaatgagtaaaccggctgtgatcaggaaaaaataatttgtaagcattaaaatagcgtgaacgaatgggagatgctatactaaaaatcatcatttcacattggaggaattcaataatggctatcgtaaaagcaactgatcaatctttctcagctgaaacaagcgaaggcgtcgtactggcagacttctgggctccttggtgcggaccttgtaaaatgattgcacctgttcttgaagaattggatcaagaaatgggagacaaactgaaaatcgtaaaaatcgatgtagacgaaaaccaagaaactgccggaaaatacggcgttatgagcatcccgactcttcttgtgttaaaagacggcgaagtagttgaaacttcagtcggcttcaaaccaaaagaagcgcttcaagagcttgtaaacaaacatctttaattttccgctgcttacatgccagagcgattccgattgagggatcgctttttttattcgccaattgtgaaccatagagaaaaacaaacgttcgtgttaaactggaaataaaggattaaacataaggaagggtaacatatgaacaaacaactgaaagaaaaactcgccctccttcctgatcaaccgggttgttatctcatgaaggaccggcagcagactgtgatctacgtagggaaagcaaaagtgctgaaaaacagagtgcgctcctacttcaccggttctcacgacgcgaaaacccaaaggcttgtgacggaaatcgaggattttgaatatatcgtgacgtcctccaatcttgaagcgcttattttagaaatgaatctgatcaaaaagcatgatccgaaatacaacgtcatgctcaaagacgacaaaacctatcctttcataaaactcacccatgaacgccacccaaggctgattgtcacacgcaatgtcaaaaaagacaaagggcgctatttcgggccgtatccgaatgtacaggcagcaagggaaacaaaaaaactgctcgaccgtctgtatcctctcagaaaatgctccaagctcccggacagagtgtgcctttactatcatctgggccaatgcctcgctccgtgcgtaaaggatatttccgaagagacgaacagagagctggttgaaagcattacacgtttcttaaggggcggctataatgaggtcaaaaaagagcttgaagagaaaatgcatgaagctgctgagaatcttgagtttgaacgagcaaaagagcttcgtgaccaaattgcccatattgaatcaacgatggaaaaacaaaaaatgacgatgaacgatctagtcgaccgtgatgtattcgcgtatgcgtacgataagggctggatgtgcgtgcaggtctttttcatccgccaagggaagctcattgaacgcgatgtcagcatgttcccgctttatcaggaagcagatgaagagttcctcacgttcatcgggcagttctattcaaaaaacaaccacttccttccgaaggagattttagttccggacagcgtagatcaatccatgatcgagcagctgctggaaacaaacgttcaccagccgaagaaaggcccgaaaaaagaactgctcatgcttgcccataaaaatgcgaaaatcgcattgaaagaaaaattctctttaatcgaacgggacgaggagcgttcaatcggggcagtgcagaaactaggtgaggcattaaatatttatacgccgcacagaattgaagcgtttgacaactcaaacatacaggggacaaacccggtttccgcgatgattgtgtttatcgatggcaaaccatacaaaaaggaataccgcaaatataaaatcaaaactgttagagggccggatgattacggttctatgagagaggttgtcagaagacgctatacgagagtgcttcgtgagaatctgccgctgcccgatctgattatcattgacggaggaaaagggcagatcaacgcagcaagggatgtcattgaaaatgaactcggcttggatatcccgatcgccggtttagcgaaagatgaaaaacacagaacctcaaatttactgatcggtgagccgctggaggtagtgtatctggaacgaaacagccaggaattttacctcctgcagcgcattcaagacgaggtgcaccgttttgcaatcagttttcacaggcaaatccgcggaaaaagcgcgtttcaatccgttttggacgacatcccgggtatcggagagaaaagaaagaaaatgctgttaaagcatttcggttccgttaaaaaaatgaaggaagcaagccttgaggacatcaaaaaagccggtgttcccacagcggcggctcagctcctttacgacaaattgcaaaaataatgttgtccttttaaataagatctgataaaatgtgaactaatttcatagttagatcgtgttatatggtgaagatagaggtgcgaacttcaagagtatgcctttggagaaagatggattctgtgaaaaaggctgaaaggggagcgtcgccgaagcaaataaaaccccatcggtattatttgctggccgtgcattgaataaatgtaaggctgtcaagaaatcattttcttggagggctatctcgttgttcataatcatttatgatgattaattgataagcaatgagagtattcctctcattgctttttttattgtggacaaagcgctctttctcctcacccgcacgaaccaaaatgtaaagggtggtaatacatgggtcttattgtacaaaaattcggaggcacttccgtcggctcagtcgaaaaaattcaaaatgcggcaaaccgcgcaattgcagaaaaacagaaaggccatcaagtcgttgtcgtcgtttcagcaatgggaaaatccactgacgaattggtcagccttgcaaaagctatttctgaccagccgagcaaacgcgaaatggatatgctgctggcgacaggcgagcaggtcacgatttcactcctttcaatggcattgcaggaaaaaggctatgacgctgtgtcttatactggctggcaggcgggaatccgtacggaggccattcacggaaacgccagaattacagatatcgacacttcggttttagcagaccagcttgaaaaaggaaaaattgtcattgttgcaggattccaaggcatgacagaggattgtgaaattacgacattgggccggggcggttcagatacaacagcagttgctttggctgccgctttaaaagctgataaatgtgacatatacacagacgtgccaggcgtgtttacaaccgatccgcgctatgtgaaatcagcgagaaaacttgagggcatctcatacgatgaaatgcttgagcttgccaatttaggcgccggtgttcttcatccgagagcagttgagttcgcgaaaaattaccaagtgccgttagaagtgcgttcaagtacagaaaccgaagcgggaacattaattgaggaggaatcatccatggaacagaatttaattgtcagaggcattgcatttgaagatcaaatcacaagagtaaccatttacgggctgactagcggcctgacaactttgtctactatttttacaacacttgccaaaagaaacataaacgtggatatcattatccaaacgcaggccgaggacaagactggaatttccttctctgtcaaaacagaagatgcagaccaaaccgttgcggtgcttgaagagtataaagacgcgctggaatttgagaaaatcgagacagaaagcaaattggctaaagtatctattgttggatccggcatggtctcaaatcccggtgtagcggctgaaatgtttgctgtactggcgcaaaaaaacattttaatcaaaatggtcagcacatctgaaatcaaagtgtcaacagtcgtaagcgaaaatgacatggtgaaagcagtcgagtcgcttcacgatgcatttgagctttcaaaacacccttcagctgtgtaatgacaatcaaaaaggcgggactatgcagtcaccgcctttttgattacactgggtctttcatatcccatttcacagtcagaaccactttatcggctctctttttcacttgttcatatgattcggcaatctgatcattcatcaattgaatttgttcagcgataaaaccagcctccagctgaaagcaaggttctttctgatgtttaagccggttggaaatgatcggcccttcaagttcaaattcaagctcctgttttttagcgcttacgttggtgagggttccccagcccgcttcttcaaagaaggccggaaattcctcccatgattcaagaggaaacttacgggcgagatgttttcctgcccaatacatcatggaagagtaatcttggccaagcatatctgggagaacgatctctcgtattagttcgtaggcataggcgttcatttcaatttcttttaggttgtcaatagatgcttcaaatttagacttcatatctgtctcccctctctcctgcgtatattatagctcaaacaggggggaggattacagaatgatcctgtaattcttatgaaaaattaagcaagaaatatatattgataaaataaaatttttcaatcaactaatcaattcggaaaattataatttatgtacgcgttttcttgacgcccttttgagggaggagtaaaatgaaattgtcaataaatcttaataaagtgcttacaattgaaagaagtgggggaagagatttagcacattttgcacttatcaaacagggggtaaagtaatgtctgggaacagagagttttattttcgaagattgcattccttgcttggcgtcataccggtcggcatctttcttattcagcatttagtcgtcaaccagtttgccgcaaggggcgctgaagcattcaatagcgctgctcattttatggatagcctgcctttcaggtatgccttggaaatttttattatcttcttaccattaatttatcatgcagtttatggtgtgtacatagcgtttactgcgaaaaataacgccggccaatacagctacatgagaaactggctattcgtcctgcagcgtgtaaccggtatcatcaccctcattttcgtcagctggcacgtgtgggaaacccgcattgccgcacaaatgggtgctgaggtcaatttcgacatgatggcgaatattttgagctctccggctatgcttggtttttacattgtcggtgttttatcaacaattttccacttctcgaacggtttatggtctttcgctgttacatggggcatcacggtaacgcctcgttctcaaagaatttcgacatacgttacgctgattatttttgttgcactgtcatacgtaggcttaaaagcgattttcgcatttgtttaagagtactagattactagagggagaggggctatcatgagtcaatcaagcattatcgtagtcggcgggggtcttgccggcctcatggcgacaattaaagcagcggaatcaggaatggcggttaaattgttttccatcgttcctgtcaaacgttctcattcagtttgtgcgcaaggcggcataaatggagcggtcaatacaaaaggggaaggtgactctccgtgggaacattttgatgacacggtatacgggggagactttcttgccaaccagccgccagtcaaggcgatgtgtgaagcggcgccttcgatcatccacttattagaccggatgggcgtcatgtttaaccggacgcctgaaggcctgcttgatttccgccgattcgggggtacacagcaccacagaactgcttatgctggtgcgacgacgggacagcagctgctttacgcactggacgagcaagtgcgcagatacgaagttgcgggtctggtcacaaaatacgaaggctgggaattccttggcgctgttttagatgatgacagaacctgccgtggaattgttgcacaaaacctgacaaacatgcaaattgaatccttccgttcagacgctgtcattatggcgacgggcggaccgggaatcatctttggaaaatcaacgaactccatgattaatacaggatctgctgcatcaatcgtttatcagcagggagcgtattatgcaaacggagaattcattcaaatccacccgacagccataccgggcgatgacaaactaagactgatgagtgaatcagcgcgtggtgaaggcgggcgcgtgtggacatataaagacggcaaaccatggtatttcctggaggaaaaatatccggcatacggaaacctggtgccgcgtgatattgcgacacgcgaaatatttgatgtgtgtgtgaaccagaagctcggcattaacggtgaaaacatggtatatctcgatctgtctcataaagatccgaaagagcttgatattaagcttggcggcatcattgagatttatgagaaattcatgggagacgacccgcgtaagcttccaatgaaaatcttccctgcggtccattattctatgggcggtttatgggtggattacgatcaaatgacaaacatccctggactgtttgcggctggggaatgtgattattctatgcacggcggcaaccgcttgggagcaaactccttgctgtctgcgatttacggaggcatggtggccggaccgaatgcggtgaaatatgtaaacggcttagaatcttcagcggaagacatgtcttcatcattattcgacgctcacgttaagaaagaagaagaaaaatgggctgatattatgagtatggacggaaccgaaaatgcctatgttcttcacaaagagctcggtgagtggatgacggcgaacgtaacggttgtccgccataatgacaagcttttgaaaacggatgacaaaattcaggagttaatggagcgcttcaaaaagatcaacatcaatgacacgacaaaatggagcaaccagggagcgatgttcacacgccagttctcgaacatgcttcagcttgcgagggtgattacccttggcgcatacaaccgtaatgaaagccggggcgcccattataaaccggattatcctgaacgtaatgatgacgaatggctcaaaacaacaatggctaaacatgtaagcccgtatgaagcgccggaatttgagtatcaggatgtcgatgtatcactgataacgcctcggaaacgggattactcgaagaagaaggtggcgaaataatcatgagtgaacaaaaaaccatacgatttattatcacacgtcaagatacagccgacagcacgccttatgatgaagaatttgagattccataccgcccgaatctgaacgtcatttccgctctgatggaaatccgccggaatccggttaatgtcaaaggtgagaagacaacccctgtcacatgggatatgaactgtcttgaggaagtatgcggcgcatgttcaatggtcataaacggaaaaccccgccagtcttgcacggcgcttatcgaccagcttgaacagccgatccgtttaaaaccaatgaaaacattcccagtcgttcgtgatttgcaggttgatcgcagcagaatgtttgattcattgaaaaaagttaaagcatggataccgattgacggtacgtacgatttaggaccagggccgagaatgccagaaaaacgccgtcaatgggcatatgaattatcaaaatgcatgacatgcggcgtctgcctcgaagcttgcccgaatgtgaacagcaaatcgaagttcatggggcctgcaccgatgtcgcaagtccgcctgtttaacgcgcatccgacaggcgctatgaataaatctgaacgattagaagcattaatggatgaaggcggccttcaagattgcggtaactcgcaaaactgtgttcaatcctgtccgaaggggattccgcttaccacttcgattgcagccttgaatagagatacaaacttacaagcgttccgcaatttcttcggaagcgacagagtataagaagaaaaaacctcttccgcatgggagaggtttttttaaacaataaggagatgaaaaaagatgaagcttcccgcttatattgatatgccgtttcaagaatggaaaacatccttttctttttttaatgaggtatccgtaagattttccgagacagacatgtttgggcatatgaataatgtaaccccttttatatattttgaggaggcgcggatttcttattttaaaaagctgaatatgatgagtgaaaacaaacagaccatgacagtcgtggcaagccagcaatgcgattatttgcgccaagtcatgccttatgaagaattgcgcatctatgtgaaaacaagcgcagtcggcagttcatctcttaccttgcactatctcggagagaacctcgaaggcgaaccctgcttcaccggggcagtcgtgatggttcaagtctcaaaggaaagcggcaaggctgtcagctggacagatgaggagaaagaaacgctccttcatacacgataaactaattatcttgtaaacgtcacctcctgcgcccttcttacatatgatatctcgactatatcaaaacccattcgtttctgattcgctctcaccttagcaaggagggttacaatacttgaaggagaaagaatttcaatcgaagccgctgctaacgaaaagagaaagagaagtgttcgaattgctcgttcaagataagacaacaaaggagattgcaagcgagctatttatcagtgagaaaaccgttcgaaaccatatttcaaatgccatgcagaaattgggtgtgaaagggcgttcgcaagccgttgttgagcttcttagaatgggtgagctagagctttaatccttgccggtattccttcttttggaaggagccggttattgctgtttgtttggaacattcgaaaccatatttggaatgctgtgcaaaacgtaggcaagtcataaattaaattttatttcttgatgttgtttgactaaagtcctctatttctctcctgcgagtcttgcattttcttcaaaaaagaaggaaaatagacacggaacgcttttgtgcgtaagagatccttgagtgagggatggacaaatgacatcaaaacctttggagcatgttgcggatattgaaaagtcactccgccacattgccgcgatcattaagcaaaaaggacgagaaatccttaaccaatatgcgattacgccgccgcaatttgtcggcttgcaatggctttatgaattaggagatatgacaatcggtgaattatcgggcaaaatgtatctggcatgcagcacgacaacagacctaatcgaccgcatgcaaaaaaatgagcttgttgagcgggtcaaggacccggcggacagacgtgttgtccggatacatctgctgcctgaaggagaacggattatccaagaggtcattacaaaaagacaggaatatctgcgtgatatgttcgaatcgtttacagatgaagaaatagccatcttcgaaaaatctttgatgaaactgcagcatgaaatgaagagaaaatgaggcgattttgttggaacaaccaataggagtcattgattccggggttggcggtttaaccgttgcgaaggaaatcatgagacagctacctaaagaaaatattatctacgttggggatacgaaacggtgtccttatgggccgcgccctgaagaagaggtgcttcaatatacgtgggagctgacgaattatttactcgaaaaccaccacatcaaaatgctggtgatcgcctgtaatacagcaacagcgatcgcattggatgacatccagcgaagcgtcggtataccggtggtcggagtgattcagcctggtgcgagagcagcgataaaagtgacggataatcagcatatcggtgtcatcggcacagagaatacgattaagagcaatgcgtacgaagaggcgcttttggcattaaatcctgatctgaaggttgaaaaccttgcctgcccgctgcttgtgccttttgtggaaagcgggaagtttctcgataaaacagcagacgagattgtcaaaacctcgctgtatccgttaaaagatacatcgattgattcgctgattttaggctgcacccactatcccattttgaaagaagccattcaaagatatatgggagaacacgttaacattatttcgtccggcgatgaaacagcccgggaagtcagcacgattctctcgtataaagggttgctgaaccagtctgcgaatgccccggatcatcagttcttgacaacaggagcgcgtgatcagtttgcgaaaatcgcagacgattggtttgggcatgaggtaggccatgtggaatgcatctcactgcaagaaccgattagaagatagttttccccgcaacggtatgttgcgggtttttttctgttttgccggaattcttcggtctatttcctaaagaggctcgtatacataatagtacaaacatccttaggagggaaaagtatgctgaaaaaaggacctgcagtcattggtgccacttgtctcacctctgccttgcttttatccggatgcggtttgtttcaatctgataaggcagccgaggaaattgatccgcctcaagacgttacattcgtgaacgatgaagcgggtgccaattcaaatacaacagcagccaaaaaaacagaaagtgaaaaaagcgataccgcaaaagcggatcaagcctcatctactgttatgagggagctttatctcattgataaaaacgggtatgttgttgcgcaaacgctgcctcttcctaaaagtgagagcacggctaagcaggcgcttgaatacctcgtacagggcgggcctgtgtctgaaattcttccgaatggcttcagagctgtattgccggctgacaccaccgttaacgttgacatcaaaaaagatggaacggcgatagctgatttctctaatgagttcaaaaattataagaaagaagacgaacagaaaatcgttcagtctgtgacgtggacgctgacgcaatttagttcgatagataaagtgaagctgagaataaacgggcatgaactgaaggagatgcctgtaggagggacaccgatctcagatgatttaagccgcaaagacggcattaatttggaaacagccggtgtaaatgatctcactgctacccatccgctgacagtctactatttggcggaaaatgaagacagtgaatactacgtgccggtgacgaaacgaatcgacaattcggaaaaagacgacatcacagcagccattaatgaattggctaaaggcccaagcaaggtgagcgggctgttaacagacttcagtgaagatgtaaagctggtcagcaaaccgaaaatcaaagacgggcgcgtgacgttggatttcaatcaatctatattcggcagcgccgatgagaagacgaaaatgatttcttcagaagtgctgaacagcattgtgctgacgttaacggagcagccggatgtaaaaagcgtctctgttaaagtgaacggaaaatcagagctggtaaatgaaaaaggcgaaaagctcacagaaccggtctccagaccatctcaagtgaatacgggtagtttttaaattgggatttttgatatactagaaagaaagaggttagcgttccggctgcctctttctttattcaattccgggacaaaaatggtttatgtacatacaatcggaggtaaaacatgagacatgacggaagacaacatgatgagctgcgcccaatcacattcgatttggattttatcagccatccggaaggttctgttctaataacagcgggaaatacaaaagtaatctgcaatgcgtccgttgaggatcgcgtgccgccgtttttgcggggcgggggaaaaggctggattactgctgaatacagcatgctgccgcgggcaacaaaccaaagaacaatcagagaatcttctaaggggaaaatttccggcagaacaatggagatccaacgcctgatcggccgcgcgcttcgagctgttgtagatctggaaaagctcggtgaacggacgatttggattgactgtgatgtcattcaagctgatggaggaactagaacagcttccattacaggcgcatttcttgctatggcgattgcgattggcaagctgatcaaagcaggaacaatcaagacaaatccgatcactgattttcttgctgcgatctctgttggaattgataaggaacagggaattttgttagatttaaattatgaagaagattcctccgctgaagttgacatgaatgtcatcatgacaggcagcggccgttttgtggaactgcagggaaccggggaagaggcgactttttcaagagaggatctgaacggtcttctgggtcttgcggaaaaaggaattcaagagctgattgacaagcaaaaagaagtgctgggtgattctctgccagaactgaaataaagacagaaaggcttgatcatcatgaaagaagcaattattgcaacacataatccgggaaaagtgaaggaattcaaagaaattcttgagccaagaggctatgatgtcaaatctttagctgaaattggattcacagaagaaattgaagaaacaggccatacatttgaagaaaatgccattctgaaagcggaagctgttgccaaagcagtgaacaaaatggtgattgcggacgactccggtctatccatcgataatcttggcggcagacccggggtttattcagcccgctatgcaggggaacagaaagacgaccaggcaaatatcgaaaaagtgctcagcgagctgaaaggtatcgaaaaagaacagcgcaccgcccgtttccgctgcgcactggccgtgagtattcccggagaggaaacaaaaacagtcgaaggccatgttgaagggtatattgctgaagaaccgagaggagaatatggctttggctatgacccaatttttatcgtgaaagataaagataagacaatggctgaactgacaagtgatgaaaaaaataaaatcagccatagggctgacgcgcttaaaaagctgtctaagcttttggaggcataaggaggaagcttgtacatgaacgtgctgattatcagtgacagccatgggcttgaagaagaactccaaaccattgcgaaacggcatgaggcagaagttgatctcatgattcattgcggggactctgagcttgaaacgaggcatcctgcattggagccttatgcggttgtaaaaggcaattgcgattttgccggcgattttaaggacgagcttcttctgactgccggctcaagaaaaatactggtcacacacggccaccttcacggtataaaacagaccttgttaaacgtatactatcgtgcagaggagctcggagcggatgttatctgcttcgggcattcgcacatcgcgggcagcgaagtgctgcggggcaaactgatgattaacccaggcagcatccggcttccgagggtgcgcaggacagaaagctatgctatactgacattagaaaatgatgctgcgtcagtccgtttttacgaccaagcaggcaatgaaattgaggatctgcaaaatcgagtcacactatgaaaatgtcatgaggaagaaaattttcttcctcatgaaaaaaattctaaaaaaccgttgacttattattgcatcccatatataataaatcttgtcgctgatagttaaagcgaaaaacaaaaaacaaaacgtgtcccagtagctcagctggatagagcaacggccttctaagccgtcggtcgggagttcgaatctctcctgggacgtaccaaaagaaaaacctcaaatccatttaggatttgaggtttttttgttgtcgtcttatgattttcatttgttatttaacggatcatcatccaagccgtcaacttttccttctttattcagacgaggttcttcttttttcacagtttcagaaatatgttcattttcttcaacagtgcgtttgccgacaaccacttcatcagtgacaaccggttttttagtcacttcaagcttttcctcaacgattggaactctaatctcttccgaatcgttgacgggagcagcgtccgttttattttcatccactggacggcgttcgacataaatttcatcatgtctcacaggaatgtccatatctcttttttctgttttcacttcttttcctatttctacttcgccggtttgaacgtcttccttatcgaccttcagctgttcttcccggagcggcatcgttttttcttctttcgttgtataatccaattcatttgtgcttgaaaagccgcctgaaagggcattgccgttatcaataggagcatttacatttgcatctgtatcgacggctaccagaagttttccgtcatccaaatcttcttgatacttgtctatttcatcagttttaatatccaagtcggataatgctttgctgtgtgtagaagtatcatccattgtgaaataatctttcagtttatcgaaaaaagattcagattcgtcctgatgtgcatcgatggcttgattgacttctgttcctgtacgtgactccaaataatctgtatctcgccggcttgtcacaacagaaatgtcatcagaatcatagccttttgtgagtaagccttcaatcgctgcgatggtttcctgcggagtttcatatacaccaactatgcttttcatatcaatctcctcctttatgaatttgcattatatcgttcatgtcgtttgtaattcccgctgctctttaaaataaacaagattgaaaacatccgagttttttagagaaaactttaattagaatttcctgaaaaatgaatatacaggaaaagatatgaaaaaattcatagtcttgccgatatttgttttgtgaaacattaaacaaaggagtgttttcttttgaaaaaatggttcgttgtttttttcttattcgttattacgctgtttcaatcgctccaaacagttagcgcggaaacagttgaatggaaagaaagagcagatttgcctgagccgcgtgtcggcgcaagcagcggtgtagtagatggaaagatatatgtgataggtggcggaactgtaaaaccaggtgcttatgggaatcaaacgtttgtctatgatcctaaaacaaatgaatggacaagaaaagccgacatgccaacagcgagggggggagctgcatcagttactgtagatgggaaaatttatgtcttgggcggaatgtcaaacgatggagctgtcaacacaatagaagtatatgatccaaaaaaagacacgtggaaaaattagatgatcttccttttgaaagaaaggttccagcctataagatttatgcagaagctattggaaagaaaatatatgttgtggcctttgaaaattctagatatgcaacgacttacagttacgatctcgaaacgaaaaaatggcagaaaaaacagaatttaaattatgaagtaaccggagcagtaaccggagcttctacagcagtaattgataataaactatatattcttggcggaactcattatataccccaaatcgtttatgtttatgatccagaaaaagacacatgggtagaaaatggtaaaggattcacagcagggtattattctgctcttacttacaaaggaaaaattctgatgactggaggggtaaaccgaattaaggtgtacgatcctaaaagtcaatcagctacagcggtaaaaaaccctaaagccccctacagaatggctcattcttctgccgtcattgatgatactctttacgtaatcggtggaagagaggaaacatccagttttactggaagtgcagcctctaaatttaaatcagtaatgtcaatttcattgaaggatttaaacataccatccgattcagaggaaactccgggagataaggataaaggatcaacaacaccttctgaaggcaattcaggagataaggacaaaggatcaacaacaccttctgaggataactcagcagaagacggagacgcccttcttgttgtcaccatggtaaacggtttgcaaaaagaatatcagctgtctatgaaagaagtgaacggattcctcaaatggtacaagcagcgtgatgccggagagggaccgggcttttatgaaatagatgagcatgacaacaacaaagggccttttgaaagtaaaaaggattatgttgtgtttaaaaatattttgatgtacgaagtaaataaatataaataaaccatccatccaaaaaccatccaatgcaatgttggatggtttttgttgacttactctattaaacgttagaagggaaaacggtaagagatagacagaccttcccctgcacttatctatccttataaaatcgtctcacaattccttcgtcataaacacactgtttggatcttcaacatagtctgcaaacggttcacagtactgaaaatcgaagctttcatacaactttcttgccggctcaaatgaagccattgaacccgtttctaagcttaaccgctcatagcctcgctttccagcttcttcaatgatatgctggagaatttgtttggcaacgccttttcttaaatgtgatgcagatgttcgcattgatttgatttctccgtgccggctgtccagttcttttagcgctccgcaaccggctagttcatcatcctcccatgcactccaaaatgttattccaggccctcttagtttctctaaacctaaggcatggatgctttccggcggggacataagcgtcatgctatgtaaatgctcattcaccagtgaaaccacctgatgaccagttaaatcatctagttttatatacattttattcctcctcaaacattcatcttaatcatattcgatcctgtttccaactataaagacagataatctgacagtattgaagcctttttggaatgtatgagttgcaaaagatcttgaaagcaaaaaagaggccgaaatcgttgttcggcccttgagattttctttaatatctaaagcctccgtgtacgcctggcgccccgctgaatccgccggcatgtatcgctggagcacttaagctgccgccatggccgctaaagcctgcacctgaaaattgctgtccgtaaaatcctgaagcgtatgggaatgaggagtacattccagagggagtggttaacgggctgtatgcctggctgaacggctgtccgtatccgtagcctccaaatggctgctggctttgctggtagaaggcaggggtagcaggataatactgctgcggaaagttggggaagcttggaaagcccgcaggaaatccttgcatgtctgcaaatgatttattcatcgtatcaccttttctttgcaagatatcattaatgtatgccgagggaacaagagaagtgcctatccgaaattgaaatggattgcaagatgatctgtcagactcaatccatatacgaaccatagcgtgttataaaatcttacatgtttatataaaattaaataattctggtttattcttgatagattaataaaaaaattataaaaacttttaacatttgcaattccttttgtaccaataatgaaagcgtatacaatatagtttgattaatcgaaattgtctaataattttaaaaaatgctgttgacactgcgtccaaagcggcgtaatatgagttcaacaaaagataaacgcaagcttcacaagcgaaaatcatcgcagtatgattctaaaaaaatgaaaaacaaacgaccttcttgaacagctggaaagccgttccgaaggctgaatatgaaaagcgcagatgaggataagtagccttgaaaaagctttccacagagaaccgggttagctgagaaccggcgaagctttacaaggtgaactcgcctcagagtgccagtctgaaatgacagtaggacttggccgggtgaacttgattcactcgttactaaagcggatagaaatatccatgagacggccgattaacaggccgtaaacaagggtggtaccgcggaaagaaaagccttttcgccccttttagctatcgcagttactgcgcggctgattgtgggcggaagggctttttttattgaataatcagctatatagctaatgaaaagatgatctttaaaggatgaaaatccaaaaggaggaactaaaatggggactaatgtacaggtggattcagcatctgccgaatgtacacagacgatgagcggagcattaatgttgattgaatcattaaaaaaagagaaagtagaaatgatcttcggttatccgggcggggctgtgcttccgatttacgataagctatacaattcagggttggtacatatccttccccgtcacgaacaaggagcaattcatgcagcggagggatacgcaagagtctccggaaaaccgggtgtcgtcattgccacgtcaggaccgggagcgacaaaccttgttacaggccttgctgatgccatgattgattcattgccgttagtcgtctttacagggcaggtagcaacctctgtaatcgggagcgatgcatttcaggaagcggacattttagggattacgatgccagtaacaaaacacagctaccaggttcgccagccggaagatctgccgcgcatcattaaagaagcgttccatattgcaacaactggaagacccggacctgtattgattgatattccgaaagatgtagcaacaattgaaggagaattcagctacgatcatgagatgaatctcccgggataccagccgacaacagagccgaattatttgcagatccgcaagcttgtggaagccgtgagcagtgcgaaaaaaccggtgatcctggcgggtgcgggcgtactgcacggaaaagcgtcagaagaattaaaaaattatgctgaacagcagcaaatccctgtggtacacacccttttggggctcggaggcttcccggctgaccatccgcttttcctggggatggcgggaatgcacggtacttatacagccaatatggcccttcatgaatgtgatctattaatcagtatcggcgcccgttttgatgaccgtgtcacaggaaacctgaaacactttgccagaaacgcaaagattgctcacatcgatattgatccagctgaaatcggaaaaatcatgaaaacacagattcctgtagtcggagacagcaaaattgtcctgcaggagctgatcaaacaagacggcaaacaaagcgattcaagcgaatggaaaaaacagctcgccgaatggaaagaagagtatccgctctggtatgtagataatgaagaagaaggttttaaacctcagaaattgattgaatatattcatcaatttacaaaaggagaggccattgtcgcaacggatgtaggccagcatcaaatgtggtcagcgcaattttatccgttccaaaaagcagataaatgggtcacgtcaggcggacttggaacgatgggattcggtcttccggcggcgatcggcgcacagctggccgaaaaagatgctactgttgtcgcggttgtcggagacggcggattccaaatgacgcttcaagaactcgatgttattcgcgaattaaatcttccggtcaaggtagtgattttaaataacgcttgtctcggaatggtcagacagtggcaggaaattttctatgaagaacgttattcagaatctaaattcgcttctcagcctgacttcgtcaaattgtccgaagcatacggcattaaaggcatcagaatttcatcagaagcggaagcaaaggaaaagctggaagaggcattaacatcaagagaacctgttgtcattgacgtgcgggttgctagcaaagaaaaagtattcccgatggtggctccggggaaagggctgcatgaaatggtgggggtgaaaccttgaaaagaattatcacattgactgtggtgaaccgctccggggtgctaaaccggatcaccggtctattcacaaaaaggcattacaacattgaaagcattacagttggacacacagaaacagccggcgtttccagaatcaccttcgtcgttcatgttgaaggtgaaaatgatgttgaacagttaacgaaacagctcaacaaacagattgatgtgctgaaagttacggacatcacaaatcaatcgattgtccagagggagctggccttaatcaaggttgtctccgcaccttcaacgagaacagagattaatggaatcatagaaccgtttagagcctctgtcgttgatgtcagcagagacagcatcgttgttcaggtgacgggtgaatctaacaaaattgaagcgcttattgaattattaaaaccttatggcattaaagaaatcgcgagaacaggtacaacggcttttgcgaggggaacccagcaaaaggcgtcatccaataaaacaatatctattgtataaaacataacaagggagagattgaaatggtaaaagtatattataacggtgatatcaaagagaacgtattggctggaaaaacagtagcggttatcgggtacggttcgcaaggccacgcacatgccctgaaccttaaagaaagcggagtagacgtgatcgtcggtgttagaccaggaaaatctttcactcaagcccaagaagacggacataaagtattttcagtaaaagaagcggcagcccaagcggaaatcatcatggttctgcttccggatgaacagcagcaaaaagtatacgaagctgaaatcaaagatgaattgacagcaggaaaatcattagtattcgctcatggatttaacgtgcatttccatcaaattgttcctccggcggatgtagatgtatttttagttgcgcctaaaggcccgggacacttggtaagaagaacatatgagcaaggagctggcgtacctgcattgttcgcaatctatcaagatgtgactggagaagcaagagacaaagccctcgcttatgctaaaggaattggcggcgcaagagctggcgtattagaaacgacatttaaagaagaaacagaaacagatttgttcggtgagcaagcagttctttgcggcggattaagcgcgcttgtcaaagccggatttgaaacattaactgaagcaggttatcagcctgaacttgcatacttcgagtgccttcatgagctgaaattaatcgtagaccttatgtacgaagaaggacttgcaggaatgagatattcaatctctgacacagcacagtggggagatttcgtatcaggtcctcgcgttgtggacgctaaagtaaaagaatctatgaaagaagtattaaaagatatccaaaacggtacattcgcaaaagagtggatcgtcgaaaaccaagtaaaccgtcctcgtttcaacgctatcaatgcaagcgagaacgaacatcaaatcgaagtagtgggaagaaagcttcgtgaaatgatgccgtttgtgaaacaaggcaagaagaaggaagcggtggtctccgttgcgcaaaattaattttttcgatacgacgcttcgtgatggtgaacagtcccctggagtgaacttgaatacacaggagaaacttgccatagctaagcagctcgaaagactcggggcagatatcattgaagcgggatttcccgcttcgtcccgaggtgactttttagctgttcaggaaatcgcaagaaccattaaaaattgttcagtaactggtctggcccgttgtgtaaaaggtgatattgatgctgcttgggaagcgttaaaggatggtgctcaaccaagaattcatgtatttattgcgacatcggacattcatttgaagcacaagctgaaaatgacacgtgagcaagtcattgaaagagcggttgaaatggtgaaatacgcaaaagaacgttttccgattgtgcaatggtcagctgaagatgcctgccgcactgaactgccgtttctagcagaaattgtcgagaaagtgattgacgcaggcgccagtgttatcaatcttccggacactgtcggctacctggctccggcggaatacggaaatatctttaggtatatgaaggaaaacgttccgaacattcacaaagcaaagctttcagcccactgtcatgatgatttgggaatggcagtcgcaaactctcttgctgcgattgaaaatggcgctgatcaaatcgaatgtgctgtgaacgggatcggtgaaagagccggaaacgcggcattagaggaaattgccgtagccctccataccagaaaagatttctaccaagtcgaaacaggcattacactgaacgagattaagagaacaagtgatttagtaagcaaactgacaggcatggctgtcccgcgcaacaaagcggttgttggagataatgcatttgctcatgaatcaggcatccatcaggacggctttttaaaggaaaaatcgacttatgaaattatttcaccggagcttgtcggcgtaaccgcagatgcgcttgtcctaggtaaacattccggacgccacgcatttaaagaccggctgactgctttaggattccaatttgacagtgaagagattaataaattctttacgatgttcaaagagttgactgagaagaaaaaagaaatcactgatgaggatcttgtttctcttattttagaagaaaaagtaacagatcgcaagattgggtatgaatttctttctcttcaagtacattacggaacaagtcaggtccctacggctactctttcgttgaaaaatcaagaaaacgcagagcttattcaggaagctgcaactggagctggaagcgtggaagcaatctacaatacgcttgagcgctgcatcgataaggacgtagagctcttagactaccgcattcagtctaacagaaaaggcgaagatgcatttgcccaggtgtatgtaagagttttggtgaacggaaaagaatcagcagggcggggcatagcgcaagacgtattagaagcatcagcgaaagcttatttgaacgcagtcaaccgtcaattggttttccagtcgaatatgagcggattgaaaaaccacacagctgtcggatcataaaagaaaggagaacggttaacttgaagaaacgtattgctctattgcccggagacgggatcggccctgaagtattagaatcagcgacagacgtactgaaaagtgttgccgaacgctttaaccatgaatttgaatttgaatatggcctgattggaggggcggctattgatgaacatcataaccccctcccggaggaaaccgttgctgcttgtaaaaatgcagacgcgatattgcttggtgctgtcggcggaccgaaatgggatcaaaatccttcggaactgagaccggaaaaagggctgctcagcatcagaaaacagcttgatttgtttgcgaatttacggcctgtgaaggtatttgaaagcctttctgacgcttcgcctttgaaaaaagaatatatagataatgttgatttcgttatcgttcgtgagctcacaggcggcttgtatttcggccagccgagcaaacgctatgtaaacactgaaggtgagcaggaagcagtagatacactgttttataagcgaacggaaattgaacgagtgatcagagagggcttcaaaatggcggcagccagaaaaggcaaagtgacctctgtagataaagcgaatgttcttgaatcaagccggctgtggcgtgaagtggctgaggacgttgcacaagagtttcctgatgtgaagcttgagcacatgcttgtggataacgcggccatgcagctaatttatgcaccgaatcaatttgatgtcgtggtgactgaaaatatgttcggtgatattttaagcgatgaagcgtccatgcttacaggctcgctcggaatgctcccgtcagccagcctatcaagctctggccttcatctgtttgaacctgttcatggctccgcgcctgatattgctggtaaaaggatggcaaatccgttcgcagccatattgtcagcggcaatgcttttgagaacatctttcgggcttgaagaggaagcgaaagctgtagaagatgcggtaaacaaagtcttggcttctggaaaaagaacaagagacttggcacggagtgaagagttcagcagcactcaggccattacagaggaagttaaggcagcaatcatgagtgaaaatacaatttctaatgtgtgacagcttacgttaagcagtcttagcgctaggtagagggaggaaataaaagatgatgcctcgaacaatcatcgaaaagatttgggatcagcatattgtaaaacatggtgagggaaagccggatcttctctatattgatttgcacctcattcatgaggtgacgtctcctcaggcatttgaaggcttgagacaaaagggaagaaaggtcagaagaccccaaaacacatttgcgacaatggaccacaacatcccgactgtcaatcgttttgagataaaggatgaagttgcgaaacgccaggtaacggcgcttgaaagaaactgtgaggaatttggcgtgcgccttgccgatcttcacagtgtggatcaagggattgtccatgtcgtcggacctgaactaggcttaacgcttccagggaaaacgattgtgtgcggtgacagtcatacatcaacacatggcgctttcggcgctcttgcatttggaatcgggacgagtgaagttgaacatgtcctttccacacagacactttggcagcagcgtccaaaaacactggaagtgcgcgtagatggaacgcttcaaaaaggggtaacggcaaaggatgtcatccttgctgtcatcggcaaatacggtgtgaaattcggcacaggctacgtcattgaatacactggggaagtattcagaaatatgacgatggatgaacgaatgactgtttgtaacatgtcaattgaagcaggagcaagagcaggtttgattgcacctgatgaggtgacgtttgaatattgcaaaaatcgcaagtacacgccaaaaggcgaagaatttgccaaggccgtagaggaatggaaggcgctgcgcacagacccgggcgctgtttatgataaatctatcgtccttgacggcaacaaaatttcccctatggtgacatggggcattaacccgggaatggttcttcctgtcgattctgaagttcctgcgccggaaagcttttctgcagaagatgataaaaaagaagcgattcgcgcttatgaatatatgggactgactcctcatcagaaaattgaagacattaaagtggagcacgtatttatcggttcctgcacgaattcccgcatgactgaccttcgccaggctgctgacatgatcaaggggaagaaggtagctgacagcgtaagggccatcgtcgtgcccggatcccaaagcgtgaagcttcaggctgaaaaagaagggcttgaccagattttcttggaagctggatttgaatggagagagtcaggctgcagcatgtgtttgagtatgaataatgatgttgttcctgagggagagcgctgtgcatcaacctctaaccgcaacttcgagggcagacaaggaaaaggtgcaagaacacatctcgtcagcccggcaatggctgcgatggctgccattcacggacacttcgttgatgtcagaaagttttatcaggaaaaaacagttgtgtaaggagtgcgcgagatggaacctttgaaatcacatacggggaaagcagccgtattaaatcggatcaatgtggatacagaccagattattcctaagcaatttttgaagaggattgaaagaacaggctacgggcgttttgcattctttgactggagatatgatgcgaatggtgaaccgaaccctgaatttgaattaaaccagcctgtttatcaaggagcttccattttaatagcaggagaaaacttcggctgcgggtcatcgcgtgaacatgctccgtgggcacttgatgattatgggtttaaaattatcattgcgccgtcatttgctgatattttccatcagaactgctttaaaaacggcatgcttccgatccgcatgccatatgacaattggaaacagcttgtcggccagtatgaaaacaagtcattggaaatgactgttgaccttgaaaagcagctgattcatgacagtgaaggcaatcaaatttcatttgaagttgatccgcattggaaagagatgctgattaacggatatgatgaaatttccttaacgctgctgctggaggatgacattaagcaatttgaatcacaaagaagctcttggcttcaagcctgaaaaagcggccggtatttgtccggcggctttttttgcctgatgaaacctttcatttcttgtgtttgttcacaggtgttgatacacttgaacaaaataaatgcctgaaaggaatataggtatgacgcatgacaagaagaacgcaaaaattattccttttcctcatctgaaagaccgccttgtggaaaaagggatgtcatcactaaaggaaaaaaagtatcaagaagcgcttgaactgttttcagaagcgatgaaatatgatgatactgaatccgatcttcacttagggatggccatctgctttttagagctgggcgagctggaagaggcaaaaagcgtgtgcgagaagatgctcaaagaaggttatggccattattttacggttttgcaggtgtacatgaccatcttaattcagctcaaaaaatacgaggaagtcaaaagcaccattgaagccgttttggaagaaaatcagctaccggcagaaagcgccgagcaattttataagctgctggatttcagccggaaaatgaccgatccggatcgtgaggacgaggcttgggccgaagaatatgaggatacaattgacaccgagaaagtgctggcaagccctgaggagcaaatgaatctcattcattccttaaaagaccgtaacgtagcaaagtatacaggattgctcaaaacaatcctccaagacccctcagcccacccgattatcaaaacgatgattgtcatgctgttggctgagcatgagtacagtaaacctgtgcacattagcaaatttggcgagtcgttgacaattgaaccatctgagattgttccgcctgatgccgccccgattctgcaccgtgttctcagggtgctggatgagacacttggaaatgaaaatccaaccttatatgcggcagtagaagaattgtggagaagacatttatacgttttatatccgttccagccgaaattgctgtcggctgacctttgggcggctgccctgcataaagtcggttacgagatgcacggaattgaaattgaaagcgaagaacttcatatgatgtatgaatttaccgacagagaactcgatgaagcttgcacaatgttaaaagatattgaagaaatttcttatttgtaaatcgcgccatatagttgaaagcgctatgtgttatgttataatatagtggttgtatttgtgtataacgggttataagaaatacggttggacaggctttgcagttcattattaacatctatacataatgattctgatctttggcagctttgtttttgttggacgaagccgaatgattgctttagaatggaagaccgacacaacctgaatagatttttggagggaaacacatgtctgtaaaatgggaaaaacaagaaggcaacgaaggcgttttaacggttgaagttgatgctgaaacgtttaaaacagcacttgatgatgcatttaaaaaagtagtaaaacaagtttcaattcctggattccgtaaaggtaaaattcctcgcggattattcgaacagcgctttggcgtagaagctctttaccaagatgctttggatattcttcttcctgtagaataccctaaagcggttgaagaagctggaatcgagcctgtagaccgtcctgaaatcgatgttgaaaaaatcgaaaaaggcgaaagcttaatcttcactgcgaaagtaacagtaaaacctgaagtgaagcttggcgactacaaaggcttaggcattgaaaaagacgacacaactgtaactgacgaagatgttcaaaacgaactaaaagcgcttcaagagcgtcaagctgagcttgttgtaaaagaagaaggcgctgttgaagaaggaaacacagttgttcttgatttcgaaggattcgttgacggcgaagcattcgaaggcggaaaagctgaaaactactctctagaagtaggttctggttcattcatccctggcttcgaagatcaattagttggccttgaagcaggtgctgagaaggatgttgaagtgacattccctgaggagtaccacgctgaagatcttgcaggcaaaccagctgtgttcaaagtgaaaattcacgaaatcaaagcgaaagagcttcctgagcttgacgatgaattcgcaaaagatatcgatgaagaagtggaaacactcgctgaattaactgaaaaaactaagaaacgtttagaagaagcaaaagaaaacgaagctgacgctaaattgcgtgaagagcttgttctgaaagcttctgaaaatgctgaaatcgatgttccgcaagcaatggtcgacactgagcttgaccgcatgctgaaagaattcgaacagcgtctgcaaatgcaaggcatgaaccttgagctttacactcaattctcaggtcaagatgaagctgcgcttaaagagcaaatgaaagaagatgctgaaaaacgcgtaaaatctaacctgactcttgaggcgattgcgaaagcggaaaaccttgaagtatcagatgaggaagttgatgctgagcttactaaaatggctgaagcatacaacatgcctgttgaaaatattaaacaagccatcggttctactgacgcgatgaaagaagatttaaaagttcgcaaagcaattgattttcttgtagaaaaccgttaatatggtgcataataatagtactaataaaacagggcgcgaatcattcgtgccttgttttgtacaattatgagttatctctttttcttggggcaatatagttaatgcagggctgttttttgtcatacatatagaatgtgcaagtcagaaacacattgttaccgtctttttggaaagtatggtaaaatgcaatacatactcgttcgtttcaagaatcattttcttttgctctgccggtaaaagaaaaagtgagacaagattaaggggtgaaagaatgtttaaatttaacgaggaaaaaggacaattaaaatgctcgttctgtggaaaaacacaagatcaggttcgtaagcttgtagctggacctggtgtatatatatgtgacgaatgtatcgaactctgcactgaaattgtagaggaagaactcggaacagaagaagaagtagaatttaaagacgtaccaaagcctcaggaaattcgtgaaattttgaatgaatatgtcatcggccaagatcaagcgaagaaatcacttgctgttgctgtgtataaccactataagcgcattaactctaacagcaaagttgatgatgttgagctttcaaaaagtaatatttcattaatcggccctacgggaagcggtaaaacccttctggcgcaaacattggctcgcattttaaatgtgccgtttgcaattgcagacgctacatctttgactgaagctggatacgtgggtgaagatgtagagaatattctcttgaagctcatccaagctgctgattatgatgtggaaaaagccgaaaaaggcattatctatattgatgaaatcgataaagtggctagaaaatctgaaaacccgtctatcacacgtgacgtgtcaggtgagggtgtacagcaggcattgcttaaaattcttgagggtacagtggcaagcgtgccgcctcaagggggacgtaagcatcctcatcaagaattcattcaaattgacacaacaaatattttgttcatttgcggcggagctttcgatggtatcgaacaaatcatcaaacgccgtttaggccaaaaagtgattggattcggtgccgacaataaagctgctgatcttgagaaagaagatcttctttcaaaagtgcttcctgaagatttgctccgtttcgggttaattcctgaatttatcggacgtcttccggttattgcaagccttgaaaagcttgacgaagaagcattggttgcgatcttaacaaaaccgaaaaacgctcttgttaagcaattcaagaaaatgcttgagcttgataacgttgagcttgagtttgaagaagaagcgctttctgaaattgctaaaaaagcaattgaacgcaagactggagcacgcggactccgttctatcattgaaggcatcatgcttgatgtgatgtttgagctgccttctcgtgatgacattgaaaaatgtgtaattaccggggcaactgtgacacacggagagcctcctcgcctcttattaaaagacggcactgaggtaagccaagataaaacatctgcataaagataagtacaaacctcctgagtggtaacactcaggaggtttttttgcatgcaactcttccggaaaaacgtttattcccgtcttctatgggagatactagcaatcagaggaatgaattggatacataaattgtttttcaggagggaccaccatgagttggacagggatcgcgttatttattcagctgttttttgggatcatcatcggtttgtatttttggaatttgcttaaaaatcaaaggacacaaaaggtcacgatagataaagaatcaaagaaggaaatggagcagcttcggaaaatgcgcgctatcagcttgtccgagccattatctgagaaggtccgccccaaaagctttaaagatatcgtcggacaggaagacggcattaaagcattaaaggcggctttatgcgggccaaatccacagcatgtgattgtctatgggccaccgggagttgggaaaacggctgctgcgcggcttgtgttggaagaagcaaaaaaacataaacaatcaccgtttaaagagcaggctgtctttgtggaactcgatgcgacaacagcccgttttgatgaaagaggaattgccgatccgctcatcggttctgtccatgacccgatataccaaggggccggagcgatggggcaggctgggattccgcagccgaagcagggagctgtcacccatgcccatggcggtgtgctgtttattgatgaaataggggagctgcatcctattcaaatgaataaaatgctgaaagtgcttgaggacagaaaagtctttttagacagtgcgtattacagtgaggaaaatacacaaattccgaatcatattcatgatatttttcaaaatgggctgccggctgattttcgcttgattggcgcgaccacgagaatgccaaacgaaattccgccagctatccggtcccgctgtttggaggtttttttccgcgagcttgaaaaggacgagctgaaaacggttgccaaaacagcagcggataaaattgaaaaaaatatctccgaagaaggcctagatcttttgaccagctacacgcggaacgggcgggaagccgtcaatatgattcaaatcgcagcggggatggctgtaacggagaatcggaaagacattacgattgaggatattgaatgggtcattcactccagtcagcttactccaaagcacgagcaaaaaatcggtgttgaaccacaggttggcattgtgaatgggcttgcagtctatgggcctaacagcggatcgcttctggaaatcgaagtgagtgtaaccgcggctcaagataaaggatcaattaacatcacaggaatagctgaagaagaaagcatcggcagccaatcaaaatcgatcaggcgaaaaagcatggcgaagggttcggttgaaaatgtattaaccgtgctccggacaatgggaatgaagccttctgattatgatattcacatcaatttcccaggtgggattccgattgatgggccgtcagcaggcattgcgatggcggcggggattttctcggcgatacacaaaattcctattgacaataccgttgcgatgacgggcgaaatcagcctgaacggtcttgtgaaacccatcggaggcgtcattccgaaaataaaagcggccaagcagtccggtgcgaaaaaggtgattatcccatatgaaaatcagcaggccatcttaaagcagattgacgggattgagattattgcagtgaagacgttccaagaagtgcttgatgaaattttggtgaatccgccaacggaacaaaaaccgtttcatatcgaaatcaataaagaatccgtttaaaccctattttgataatagggtttttttcatgaaggacatcttttcctttttcatatcagaaagaaagggtatactacgaggagactgttttatagaaaatggaaccatgccgtttattgtacaaggatgaaaaagttgtattataatggttcatactaaagtcacggaggtgtcagtcacatggcagaagaattaaaacgcagcatcccgctcctccctttaagaggtttattagtgtacccgacgatggttttgcatttagatgtaggacgtgacaagtcggttcaggctcttgaacaggcaatgatgcatgatcatatgatatttttagccactcagcaggatatttcgatagacgaacctggtgaagacgagattttcactgtcggcacctatacaaaaattaagcaaatgctgaagcttccgaacggtacgattcgtgtgttggtggagggcctcaagcgcgcccatatcgtcaaatacaatgaacacgaggattacacgtcggttgacattcaacttattcatgaagatgattcaaaagatacagaagacgaagcattgatgcggactttgctagaccactttgatcagtacataaaaatttctaaaaaaatctcggccgaaacgtacgccgcggttactgatatcgaagagccggggagaatggcagacatcgttgcttctcatctgccccttaaactaaaggataagcaggatattttagaaacggctgatgtcaaagacaggctgaacaaggtcattgattttattaataatgaaaaagaagtgctggagattgagaaaaaaatcggccagcgcgtcaaacgttcgatggagcgtacgcagaaggaatactacttacgagaacaaatgaaggcaatccaaaaagagcttggcgataaagaaggcaaaactggcgaagttcagacgctgacggaaaaaatcgaagaagcaggcatgcctgagcatgtgaaggaaacagcgcttaaagaattgaacagatatgaaaaaattccgtcaagttctgcggaaagctccgtgatccgcaactatatcgactggctggttgctcttccgtggacggatgaaacagatgataagcttgatttgaaagaagcaggacgtctcttggacgaagagcatcacgggcttgaaaaagtaaaagaacgtattttagaatatttggctgtccagaagctgaccaaatccctgaaaggcccgattctctgtttggcaggacctccaggtgtcggaaaaacgtctttagccaaatcaattgcaaaaagcttgggacgcaaattcgtcagaatctcactcggaggagtacgggacgaatcagagatacgcggacacagacggacctatgtcggagcaatgcctggacggattattcaagggatgaaaaaagcgggcaagctgaatccggtcttcttattagacgaaattgacaaaatgtcatctgattttagaggagacccgtcttccgctatgcttgaagtgcttgatccagagcaaaacagcagcttcagtgatcactatattgaagaaacctttgatttatcaaaagtgctgtttatcgcaacggcgaacaatttggctacaattccagggccgctcagagatagaatggaaattattaatatcgcaggctacacagaaatagaaaaactcgaaatcgtaaaggatcacttgcttccaaagcagatcaaagaacacgggctgaagaaaagcaacttgcagctgcgtgatcaggcgattcttgatattattcgttactatacgagagaagcgggtgtaagaagccttgaacgccagcttgccgcaatttgccgtaaagctgcaaaagccattgttgctgaagagcgaaaacggattacggttactgagaagaaccttcaagactttatcggaaaacgtattttcagatatggacaagctgaaacagaggatcaggttggtgtagtgacagggcttgcttatacaaccgttggcggagatacgctgtcgattgaagtatcgctttctccggggaaagggaaattaatcctgacaggaaagctcggagatgttatgagagagtctgctcaggctgcattcagctatgtgcgatccaaaacagaagaactgggcattgaacctgactttcatgagaagtatgatattcatatacatgtaccagagggtgcggtgcctaaggatggtccgtcagccggcattacgatggcaacagcacttgtttctgctttaacggggcgggcagtttctcgtgaagtcggcatgactggggaaattacgcttcgcgggcgcgtgctgccaatcggcggactgaaggaaaaagcgcttggcgcacatagagcgggattgaagaccattattgcgcctaaagagaatgaaaaagatatagaggatattcctgaaagcgtcagagaggggctgacatttatattggcatcccacctagacgaagttttggaacatgccttagtaggagagaagaaatgaaagtcacaaagtcagaaatcgtgatcagtgcagtaaaaccggaacagtaccctgaaggagggctaccggaaattgcattggctggaagatcaaacgtaggaaaatcgtcttttatcaattcattaatcaatcgcaaaaatcttgcgagaacatcgtcaaagcctggaaaaacacaaacgcttaatttctacattatcaatgatgaactgcattttgtggatgtgccggggtacggttttgccaaagtgtcaaagtctgagcgtgaagcttggggcagaatgattgaaacctatatcacgacacgtgaggaattaaaagcagtggtacagatcgttgatttgcggcatgcgccatctaatgatgatgtacagatgtatgaatttttaaagtattacggcattcctgttattgttatcgctacaaaggcggataagatcccgaaaggcaaatgggacaaacacgcgaaggttgtccgacaaacattaaatattgatccggaagacgagctgatcctcttttcttcagaaacgaaaaagggaaaagacgaagcttggggagcgatcaaaaaaatgataaaccggtagaggatcctctaccggttttatttatcgtatagatttttttcgttttatcaataataacaataaactgattccaataaagacaaacggccaatactccttcagaagcgctgttggaatatgtgcagactcaagccatgccataatttgtttgaaaaagtacaaaaacagggaaaaacaaatcatcgacacagcttcatatacatattcttttttttgaacggttgaaacgagaagtgagaagccgatcataaagaggagcatttcaaaatcacccggccaccatacccatttcggcttggcaaaaaagtgtaagccgatcccgaagagaagcaaaccaataaaaaaatggggtgtaacggcttctttttttccttgatatacaaaggctgcgcctaataacatgaggagaacaggccattgatcctgccctgaaaacagttcggcttgaccgctttctagccatgcatatacagaagcggcaagcagcagacaagggaataaaattgatttttgtttcatgcatatcaccttcttgttttttagagctgatgtgtagtaaatttctgctgtttttggtattgtcaataggaatgcttcttttccctgaagctttttctaatatagcataagaattttaaaatctgttcacattttgtgaaagaaactatgttataattattataaataatgagttctatgttagaatgattataaattaagattgggtgttgggggtgtaattagagcgatgcatatacttgttgtgggagtagattataaatccgcccctattgagatacgtgaaaaagtaagttttcagccgaatgagctggcagaagcaatggtgcagctgaaagaagagaaaagcattcttgaaaacatcattgtctcaacctgcaaccgcactgaaatttatgcggtagtcgaccagcttcataccggccgttattatataaaaaagtttttagctgattggtttcaattaagcaaagaagagctgtcaccgttcttaacgttttatgagagcgatgccgctgttgagcatttattccgtgtagcctgcggacttgactctatggtgattggcgaaacgcagattctcggacaggtacgcgacagctttaaaacagctcagcaagaaaaaacgatcgggactatttttaatgagctgtttaagcaggcggttacagtgggcaagcggactcacgccgaaacagacattggctcaaatgcggtgtcagtaagctatgctgcagttgaacttgccaaaaaaatcttcggaaatctttcaagcaagcacatattgattctcggtgcgggaaaaatgggcgagcttgctgcggaaaacctgcacggacagggaatcggcaaggtcactgtcattaaccgaacatacttgaaagcgaaggagcttgcagaccgtttctcaggtgaagcgagaagcttgaatcagcttgaaagcgcgcttgcggaggctgatattttaatcagttcaaccggtgcaagtgaatttgtcgtgtccaaagagatgatggaaaacgcgaataagcttcgcaagggacgtccgctgtttatggtcgacattgccgtgcctagagatcttgatccggcgctgaatgatcttgaaggtgtttttctttatgatatcgacgatctggaaggcattgtagaagcgaacatgaaagagcggagagaaacagctgaaaaagttgaactgttaattgaagaaaccattgtggaatttaaacaatggatgaatacacttggtgttgtgcctgttatttctgcattgcgcgaaaaggcgcttgccatccagtcagaaacgatggacagcattgagcgtaagctgcctcacttaagcacaagagagaaaaaactgttgaacaaacacaccaaaagtattattaaccaaatgcttcgtgatccgattttaaaggtgaaagagcttgcggcagatgctgattctgaagaaaagctcgcgttgtttatgcagatttttgatattgaagaagctgcgggccgtcaaatgatgaaaaccgttgaaagcagccagaagatccactcttttaagaaggctgaatcaaaagcgggctttagcccacttgtaagtgagtgaaagctgaatgattgatactgcaatggcaagacttaatgaggggacaatcgtcatttacgcgttaagtgtactcttttattttatagattttcttcaacacaaccggaaggctggaaaaatggccttctggttgctttctattgtctggactctgcaaaccgtgtatttggcctattttatgtgggtgacggggcggtttccggtattaaatgtgacggaggcgctttatttttatgcctgggtgcttgtcacgctgtcacttgtactgacaaagcttttacgtgttgactttatcgtgttttttacaaatgttataggattttctatgatcgccattcacacattttcaccgacagagcagcagtcagctgctttttccgggcagcttgtatccgagcttttggtgattcatattacaatggcgattctttcatacggcgctttttccctttctttcgttttttctgtgctatatatgtttcaatatcatctgctgaaaaagaaaaagtggggaaaatggctgttgagaatagaagatttatctaagcttgattatatggcgtatgttttaaatgtcattggggttccgatgctgctgctgagtttgattctcggcgtcatttgggcatatgtctcactagaaacgctgtattggtttgacgccaaagtgcttggttcgtttgtcgtcctgctgctgtacagctattatctttatatcaggctgattaaagagctgcaaggaaaggtcgctgcactgtggaatacggcttgttttctggtgctgatgatcaattatttcctgcttggaagcctgtcgcaattccattggttcagttaaacgatgtcccaagcagattcgggaggaaagaaatgatgagaacgattaaagtaggttccagacggagcaaactcgctatgactcaaacaaaatgggttattcaaaaactgaaggaaatcaatccttcgtttgcttttgaaattaaagagatcgtgacaaagggcgaccggattgtcgatgttacactctcaaaagtgggtggaaaagggctgtttgtcaaagaaattgaacaggcgcttttaaacgaagagattgatatggcagtgcacagcatgaaggacatgcctgctgttttgcctgaaggccttgtgatcggctgtattcctgaacgggaggacccgcgtgatgcccttatttcaaagaatcgcgtaaagctttcagaaatgaaggaaggtgctgtcattggcacaagcagtttaagaagaagcgcgcagcttttgattgagcgccctgaccttacaattaaatggattagaggtaatatagatacaagacttcaaaagctggaaacagaggattatgacgcgattattttagcggctgccggcctttccagaatggggtggaaacaagatgtcgtaaccgaattccttgagcctgagcgctgtttgcctgctgtggggcagggagccctggcgattgagtgccgagaatcggatgaagagctgttggcgttgttttctcagtttacagatgaatatacaaaacggactgtcttagcagaacgtgcttttttaaacgcgatggagggcggctgccaggttccgatcgcgggctactccgtgttaaatggacaggctgaaattgaaatgacaggtcttgtcgcttcacctgacggcaaaatcatttttaaagaaaccgtcaccggaaacgatccggaggaagtaggaaagcgctgtgccgctcttatggctgacaaaggagcaaaagatttaattgatcgtgtaaaacgggagcttgatgaggatggaaaatgattttccgttgaaaggaaaaacagtgcttgtcacccggaataaggcacaagcaacatcatttcagcaaaaagtgaaggcgcttggcggtaaagcggttttaacctctttgattacgtttcgccgcgctttgccgaatgatgttgcggaacaggtaagggaggatctaaccgcgccaggctggcttgtttttacaagtgtgaacggggcagacttctttttttcttatctgaaggaaaatcagcttattctccctgcgcataaaaaaattgcagccgtcggtgaaaaaaccgcccgccgtttaaaaacgcataacgtatcggttgatgtgatgccacaggagtatattgctgaacaattggctgacgctcttaagcagcatgctgaaccgggggagcccattaccgtgatgaaagggaatttgtcacgtgatgtgataaaacaagagcttgtcccgctcggttttgaagtaaaggaatgggttctctacgaaacgattccggatgaagaaggcattgaggcactgaaagacgctgcgggtcaatattcctttgactatgtaacatttacgagttcatcaaccgtacatacgtttatgcatgtcttgggagaagaattaaaaaagtggaaggcgaatgggacggcgtgtatcagcattgggcctttaacaaatgatgcccttctgacgtacggcatcacatcgcatacgcctgatacatttacaatagatggcatgcttgagttaatgtgcagcatgtcaagagaggaagagagaatatgagtcaatcatttaatagacaccgccgcctgcggacatcaaaagcaatgagggaaatggtaaaggaaacacgtttgcatccatcagattttatttatccgatttttgtcgttgaagggctggaaggcaaaaaagctgttccgtcaatgcctgatgtttaccatgtatcattagatttattgaaggatgaagtagcggagctggtcaaactgggcattcaatctgttatcgtgttcggcatcccggaagaaaaagatgattgcggaacacaagcgtaccatgatcacggaattgtccaaaaagccatcacagaaattaaagaacacttccctgaaatggttgttgtcgctgacacgtgcctgtgcgaatatacagaccacggccattgcggacttgtcaaagacggggtcatcctcaatgatgaatcgctggagcttttggcgcagacagctgtcagccaagcgaaagcaggtgcggatatcattgcgccatcaaacatgatggacggatttgttacagtgatcagagaagcgcttgataaagaaggattcgtcaatattcccatcatgtcttacgctgtgaaatattctagcgagttttacggtccgttccgtgatgcagcaaacagcacaccgcaattcggagaccgcaaaacatatcagatggaccctgccaaccgtatggaggcactccgcgaagcacaatcagatgtcgaggaaggcgcggactttttgattgtcaaaccttcgctttcttatatggatatcatgcgtgacgtaaaaaatgagtttacttttccgctcgtcgcttataatgtaagcggagagtattcaatggtgaaggctgcagcgcagaacggctggatcaaagaaaaagaaattgtgttggaaattttgacaagcatgaagcgcgcgggtgccgacctgattattacgtatcatgcgaaagacgcagcgaaatggcttgcggagtaattttattcagttgacaggagttgaggcagatgagaagctatgaaaaatcaaaaacggcttttaaagaagcgcaaaaactcatgccgggcggtgtgaacagtcccgttcgcgcatttaaatcggtagacatggacccgatttttatggagcgcggaaaaggctcgaaaatctttgatattgacgggaatgaatatattgactacgtcttgtcatgggggcctttaattttagggcatacaaatgaccgcgtcgtagaaagcctcaaaaaagtggctgaatacgggacaagcttcggtgctccgactgaagtagaaaatgaactggctaagctcgtcattgatcgtgtgccatctgtagaaattgtacgaatggtaagctccggaacagaggctacaatgagtgccctccgtttggcaaggggctatacgggccgcaacaagattttaaaatttgagggctgctaccacggacacggcgattctctcttgattaaagctggttcaggtgttgccactctcggtctgcctgacagcccgggggtgcctgaaggcattgcgaaaaacaccatcaccgttccgtacaatgatttagaaagtgtaaagcttgctttccagcaattcggtgaagacattgcaggagtcattgtagagccagttgccggaaatatgggtgttgttccgccgcaagaaggtttcctgcagggtctgcgtgatatcactgagcagtacggctccctgctgatttttgatgaagtgatgactggcttccgggtcgattataactgcgctcaaggctacttcggcgtaacgcctgatctgacttgtttaggaaaagtaatcgggggcggacttcctgtcggcgcttatggcggaaaggcagaaatcatggagcagatcgctccaagcggcccgatctatcaagctggtacattgtcaggcaacccgcttgcgatgacggctggcttagagacattgaaacagctgacacctgattcctacaagaaattcatcaaaaaaggcgacagactggaagaaggaatttcaaaagccgccgaggctcatggcattccgcatacctttaaccgtgcaggttcgatgatcggtttcttctttacaaacgaaccagtcatcaattatgaaacggcgaaatcatctgatttgaagctgttcgcaagctattataaagggatggcaaatgaaggggtattccttccgccatcacaattcgaaggtcttttcctctcaacggcccatactgatgaagatattgaaaacacaatccaggcagctgagaaagtatttgctgagatcagccgcagataagagtgaaaaccggtatcaaggactccttgtgccggttttttcgtgctctgccactcatattttctccagttcatacatacacctttagtgacatctaattttaaggattagatgaaaggaggatatgaacttgccgcaaaatcatcgattgcaattttctgtagaagaatcgatctgtttccaaaaaggacaggaagtttctgaactgctttctatttcattagatcctgatattagggttcaggaagtaaatgattatgtatcaatcataggatcgcttgaacttacaggtgagtacaacatagatcaaaacaaacataccgaagagatttatacagataagcggtttgttgaacaagtcagaaagagagaggatggaagtgcggaactgactcactgttttcctgtggatattaccattccgaaaaataaagtgagccatttacaggatgtcttcgtctttattgacgcatttgactatcaattgacggattcgcgcattttaacaattcaagctgatttagcgatcgaagggcttttggacgatacgcaagacaaagagccggagatacctttatatgaagctcctgcggcattcagggaggaagagctttcagagccgccggcacatagtgtagtagaagaaccgggtgcatcatcggcagaggaagcagttcttcagcatgaaccgccagccgaaccgccagaactttttatctcgaaagcggggctccgtgaagaactggagacagaaaaagcagaatctgagccgcctgaatcggttgcttcagaaccagaggccagagaagatgtgaaagaggaagaagagtcagaagagcttgctgtgccggaaacggaggttcgtgctgaatcggaaacagaagaatctgagccagaacctgatccttcagaaatagagattcaagagatcgttaaagcaaaaaaagaaacggcagagccggcagctgcaatagcggatgttcgtgaagaagcagactctccagcggagactgagcttcgtgaacacgttggagcagaagaatcgcctgctttggaagctgagcttcattcagagactgtgattgcagaggaaaaagcggaaacaacagtgtctcctaatcatgaatatgcgctgcgccaagaggctcaaaatgaagaagcagctcaatcggatcaggctgatcctgcgctttgccaagaagaggcggaaccggatgaagctttggagagtgtatcagaggccgctctctccgtagaagatagcagagaaacagcttcagctgtatatatggagaatgacaatgccgatttacatttccatttcaatcaaaaaacaagctcggaggaggcatctcaagaagaattgcctgaaccggcataccgtaccttcctgcctgaacaagaagaggaggattctttttattcagcgcctaagctgctggaggaggaagaacaagaggaagagagcttcgaaattgaagtgagaaaaacaccatcacctgaagagcctaaggaagaaacaccttttcaatccttccagctgcctgaatcttctgagactgaaaggaaggaaacggatgctgttcctagggttgctcctgctgctgaaacgaaggaacctcaaacaaaggaaagtgataattctctttatttaacaaaactctttacaaaagaagcggatgagttttcgagaatgaaaatttgtattgtgcagcaggaagatacgatcgagcgtttatgcgaacggtatgaaattacatcccagcagctgatcaggatgaattctttagccttggatgatgaattaaaagcaggacagattctctatattcctcaatataaaaatagccatgcgtaaaccgtaagcgatcggaaaatgtggtgaatgaaatggaagatacccaatcggttcttcaggaatacggactgactgctcaatttattgagcctgtcagtcctcttgtttggaaagtgtatacagactacggcgtatttgccctgaaaaaattgaaagagggtcgcggcaagcattttacagatcatatggtggcgattgaggaaaaaggctttcgttcattcgttcccgtgtacagaacaaatagcggtgagtttttctcagcaggcatacaatacggagatacctactatttaatgccttggctccaatttgaccaagaggaagaacgggatcagaaacatgcttatttatttagggaaacagcccgtcttcacgagagaactgcacaggaactaaaggttagacgtgatgagattgaacgttattacgggcaaacgaaaaaaaagtgggaacaagataaaattttctatgagcagtttgtggatagagcggagaaggaatggtacctttctccctttgaactccaggccataacctatttttctgaaaccatttccgcggtgaattttgcgctggaacggctggaggactggtatgagtctgcaaaggaaaaggacgtttcaagggttgtaatgaaccacggcagcctgtctatacaccattttctgtataatgatgcagggaccggatattttacaaacttcgaaagagcatctgtcggtccgccgcaaaacgacctgctcggcttttatacaaaaatgttcagaggctttccgaaagcttgtccggaatgcgtcgaatggttttatggatatacgaaatcattccctttgcgtgaagcggaagtcagcctttttctcagctatatggcatatccggcatccatgtacaaggtgctgaacggttatcaaactgggaaaagacaacatgaaaaagaggaatgtacacaattattaaaggcttattggcaaatgaaaaatatagagccgtttgtgatgaaaattcatcagattgaacaagagaaaaaatttcaggctgaaaacgagtccacgtcttaatggcgcggacttgtttgtttatatccattctaaatgaagggcgcaagctaaaaagattaggattgcgagcagcaaaacatcaaaggttgtcggaaagaaaatggttctgattccttgaaaaatcgtaatgggaataatcacttgtgcggatacaagccgaatttgccttacccatggcggcagtgaataagagctgaaacgtttcttcacggtgcatcctcctctacgcatttacaagcatcatatgtaaacttgggcaataggtgcctgcccatctgtatagaaagcggtgtttttggaaaagatgattgacgaatcaaaaacacttttactataataaagaacataaataatgtacaatgagctgataaatacacctgcttagaacgggaagagtacaaaaaaggcgcatgcagagagagaagccgtttgctgaaaggcttcttatgttgtctgattggaaggtcgcccgggagcataatttcttgaaagaagagtagagaaattcgggaaacacccgttatccgttataagtgcatgaactgatagagttcatgaaaaaaggtggtaccgcgaaagagcttttcgtccttttacagggatgaagagctcttttttcgttctcagccatttttaaacatgctggagggttatgatggaaacgaatgaacaaacaatgccgacgaaatatgatccggcagcggttgaaaaagaccgatatgatttttggctaaaaggcaaattttttgaagcgggcagtgaccagacaaaagagccatactctgttgtcattccgccgccaaacgtaacaggaagacttcaccttggccacgcatgggacacaacgctgcaagacattgtaacaagaatgaaacgcatgcagggctatgatgtgctgtggcttcctggcatggaccacgccggcatcgcgacacaggctaaagtagaggcgaaacttcgtgaagaaggcaaatcccgctacgatttaggccgtgaaaaattcctcgaagaaacgtggaagtggaaggaagaatatgctgactttattcgcagccagtgggcgaaattaggtcttggcctagattattcccgtgaacgttttacgctggatgaaggcttgagcaaagcggtaagggaagtattcgttaagctttatgaaaaaggcctgatctacagaggcgaatatattattaactgggacccagcgacaaaaacagccctatccgacattgaggtgatttacaaggatgttcaaggcgcattctatcatatgagctatccgcttgctgacggttcaggctcaattgaaattgcgacgacacgtcctgaaacaatgctcggtgatacagctgttgccgttcaccctgaagacgagcgctataaacaccttatcggaaaaacggtgatcctgccgattgtaaatcgtgaaattccgattgtcggtgatgactatgttgatatggaatttggttcaggtgccgtgaaaattacgcctgctcatgatccgaacgacttcgagcttggcaaccgccacaatttagaacgcatccttgtcatgaatgaagatggcacgatgaatgaaaatgcgctccaatatcaaggtatggatcgttttgaatgccgcaaaaagctcgtgaaagatttacaggaggcgggagttctcttcaagatcgaggatcatatgcactctgtcggccatagtgaacgaagcggggctgttgtggagccttatctttctacacaatggtttgtgcgcatgcagccgcttgctgatgcagcgattgagctgcaaaagaaagaagaaaaggtcaactttgtgcctgaccgtttcgaaaaaacgtatttacactggatggaaaatatccgcgactggtgtatctcccgtcaattgtggtggggccatcgtattcctgcctggtatcataaagaaacaggcgagctatatgtcgggcttgaagcgccggaagacagcgaaaattgggaacaggatacagacgtactggatacatggttcagttctgcgctatggcctttctccacaatgggctggcctgatgtaacggctgaagactttaaacgctactatccgacagatgttctcgtgacagggtacgatatcattttcttctgggtatcacgcatgattttccaaggcattgaatttacaggcgagcgcccgttcaaagatgttttaatccacggcttaatccgtgacgagcaaggccggaaaatgagtaaatctcttggcaacggtgtcgacccgatggatgtgattgacaagtacggagccgattctctgcgttatttccttgcgactggaagctctcctggccaggatctgcgcttcagctatgaaaaagtggaatcgacctggaattttgccaataaaatttggaacgcctcccgttttgcattaatgaatatggatggcatgacgtacgatgagcttgatctgtcaggtgaaaagtcagtcgctgacaagtggattttaacgcaattaaatgaaacgatcgagcacgtgacccagcttgctgaccgatatgaatttggtgaagtaggacgccatttatataactttatttgggatgatttctgtgattggtatattgaaatggcgaagcttccgctttatggagaagacgaagcggctaagaaaactacccgttccatccttgcttacgtacttgatcaaacgatgcgtctgctccatccgtttatgccattcttaacggaggaaatttggcagcaccttcctcaccaaggggaatcgattacagtaagtcaatggcctgcagtagtgccggagcataccgatactgaagcggcagctgacatgaagcttcttgttgagctgatccgttctgtgcgcaatatccgcagtgaagtcaatacgccaatgagcaagcaggttgaactgtacattaaaacaagcacagacgaaatagcatcccgcctcgaagcgaaccgttcatatgttgaacgctttacgaatccgagcgtgcttaaaatcggcaccgatattgaggctgttgataaggcgatgacggccgttgtctcaggagcagaggttattcttccgcttgaaggcttaatcaatattgatgaagaaattgcccgtctgcaaaaagaatttgataaactgacaaaagaagttgagcgtgtccaaaagaaacttggaaatgaaggatttatgaaaaaagcgcctgcacacgtaattgatgaagaacgtgaaaaagaaaaagattatgtggcgaagcgtgacgctgttcaaaaacgaatggctgagctgaagggttaatgaaaagccggggcggtttctagagaaaccgccttgtcttataaaagaggggattatcattgtttactgcatatcaagatgcgcgcagctggattcacgggaggctaaaattcggggtgaagcccggacttggtcgaatgaaacagctgatggcgcggttaggacatcctgaaaaaaaaatccgagcgttccacgtcgcaggaacaaacggtaaaggatcaactgtcgcttttatccgttctatgctgcaggaagccggatatacggttggaacatttacatcgccttatattattacgtttaatgaacggatcagcgtaaacgggataccgatttcagatgaggaatggacagcactcgtcaatcaaatgaaaccgcacgttgaagcccttgatcaaacggaatacggacagccgacagaatttgaaattatgacggcctgtgcatttttatattttgcagaatttcataaggtcgattttgttatttttgaaacaggtctgggcggtagattcgattctactaatgtggttgaaccgctcttaactgtgattacaagcattggacacgatcatatgaatattttgggaaacaccattgaagaaattgcaggagaaaaggccggtattattaaagaaggtattccaatcgttacagcagttacccagccggaagctttacaggtcatccgccatgaagctcaacggcatgctgcgccgttccagtcattgcatgatgcatgtgttattttcaatgaagaggctctgcctgcaggagaacagttttcattcaaaacggaagagaaatgctatgaagatattcggacatctctgattggcacccatcaaagacaaaatgctgctttgtccattttggctgcggagtggctcaataaggagaatatcgcccatatcagtgacgaagcgttaaggagcgggcttgtgaaggctgcttggccgggacggttagagcttgttcaggaacatcctccggtatatttagacggtgcgcataacgaagaaggtgttgaaaagctggcggaaacgatgaagcagcgtttcgccaattcacgcatttctgtggtgtttagcgcgttaaaggacaaaccgtatcagaacatgattaaaagactggaaaccattgctcatgcgattcattttgcttcttttgatttcccgcgtgcttctcttgcaaaagatctctataatgcaagtgaaatcagcaataaaagctggagtgaagatccagacgatgtgatcaaattcatagaaagcaaaaagggctcaaatgaaattgtgctgattaccggatctctttactttatttctgacattcgaaaaaggttgaaataaaagtatccggctccggcagaatcaaaaaaaagattctgccgtttttttatgtgtaaaattgaatatttccaattggagctcaggatgtccattttgctacaatccataccagaactcaatgagtaaaggtgtgttgtctatgctatccattctttttatcttcgggcttatccatggttctttttactatacggccgggtgccgtatccccttacatctatctattattgcgccccgttcatcatgcccgttttgccggcggacattaactcctgcagaattaattcccatcctgtcattcctatttcaaaaaggtaaatgtaaaagctgcgggcataggatttcttttatgtatcccgcagcagagcttgtgacagcgtgtttatttgccgccgcaggaatacgctttggcacgtcgctggaactgtttcccgctgtggtgtttatctctcttctcattattgttgcagtgacagatattcattttatgctgattccaaatcgaatattgcttttctttcttccctttttggcggccgcgagattgatttctccgcttgattcctggtatgcaggcctgttaggtgcggcagccggatttctatttctggctgtaattgccgcaatcacccatgggggagtagggggaggagatattaaattatttgcggtgattggctttgtgcttggtgtgaaaatgctggcagctgcctttttcttttctgttttgataggtgcattatatggagcggcagccgttctgactggtagactcgctaaaaggcagccgcttccctttgcccccgctatagccgcagggagcattttagcctatttatacggtgactctatcatttctttttatatcaaaatggcattgggctgactgctgaaaaatttgacgaacgttttttggagaaggcgacaaaagtcttgttctttttttctttgcctgtgctaaagtgtgtagcatgaaaagccgacaagaacggtcaagcaaatgaagggaggaagcggaattgaaaaaaagaaagaataaaaaaaacagtaaagccgcagaaaaagccctcaaggtgacgattaatggaaaagaagagacggtttacgaacaagagacgcctgagacagagacggataaaagcatgacattttcaaattgggaggaaaaaagacaggcagaacaagaggttgcggcatcccaggaacatcctgatgaagatgaattcaattgggattcagaggaagacaaggtgtttaaagaggaccctaaagttgttcctccttatcaaaagaaaaaaacaaagtcttatgcaaaaggaaagaccgggactgccaaaccagtaaaaagagtggctgcgacgattgccttcgcggctgtcattggcactggattagggctattcgcgttaagcatatcggggaataaagaagcgtcagcaccggcctctttagaggattctctaggcagccaaacggcaaaagcaggggatacttcaactgataaacaaacttcaggcacagaaaaacaagcggcgcaaactgaaggtacatataaaacatacgctgtacaagccggaaaattttcaaatgaaaagggtgccgaaacgttaacagaacaattgaccgaaaaaggatattccgccgtgtcactgtcaaaggatgacgggtatacgtatgtcatcgcgggcttagccagtgataaggatgtctcacagcagttaggacaggttttaatcgacagtgattttgaagcctggggaggcaaggagctttccttatcaatagagtcagatatgacagattcttttaaggaaacagcggagcttgcagcaaaggcgattctcggcgaagacattacaaaagcgagtgtagagaaaatagaaaagtctcttggtgaaacaaaagcgtcagaaacaggagagaaaaaagcgattttgcaggctttaaaggaattagaggatccaagtgctgaagccgggtggaaggctcagcaggagctgttagccgtcgttaaataagagatagcaccctgagccttcgtcctttagtgacaggctttttttattttgtcatgaaaaagttatttttctgaaattgtgacaagcctcgtgatttggtaggataaacgagtatctttttttcttaagcaaaccctgaaaggatgacgaacatgacaaaaccgctaatacttgcatcacaatctccgcgcaggaaagaactcctcgatcttctccagctgccctactccattattgtcagtgaagtagaagaaaaattaaatcgaaacttttcaccagaagaaaacgtccaatggttggcaaaacaaaaagctaaggctgtagctgatctccacccgcatgcaatcgttatcggtgctgatacaatggtatgccttgacggcgaatgccttggcaaaccgcaggatcaagaagaagctgcatctatgctgcggaggctttcaggccgaagccactcagtaataaccgcggtcagcattcaagctgaaaatcacagcgagactttttatgataagacagaagttgcgttttggtccctcagtgaagaagagatttggacgtatattgaaacaaaagagccgatggataaagcaggtgcatacggcatccaaggaagaggcgcgctttttgtaaagaaaatagacggagattactattcagtcatgggccttcctatatcaaaaacaatgagagctcttcgccattttgatataagggcatgacggttctataaacgggaagggaaagaaaaggagtgcttggtcatacacgatctgccattaaaactcaaagatttcccaatgaaagaaaagccaagagaacggctcctgaaagtcggagccgagaacttagcgaatcatgaacttttggctatattattgcggacagggactaaacacgaatctgttttggacctgtcaaaccggctgctgcgctcatttgacgggctgcgcctgctcaaggaagcatcggttgaagagctgtcaagcatcccgggaatcggtatggtaaaagcgattcaaatactggcagcagtggagcttggaagccggattcataaattagccaacgaagaacatttcgttattcgctccccggaagacggcgctaatcttgtcatggaggatatgcgctttttaacccaggagcattttgtctgtttatacttaaatacaaaaaatcaagtcatccataaacgcaccgtatttatcggaagcctgaattcatctattgtccacccgcgagaggtgtttaaagaagcgtttaaacgatctgccgcttcctttatctgtgttcataatcatccttctggagatccgacgccgagcagggaagatattgaagtgacaagaaggctgtttgaatgcggaaacctgattggcatcgagctgcttgaccatttggtgatcggggataaaaaatttgtgagtttaaaggaaaaaggatatttgtaacactttttttttcgtcgaattaagctataatagagtttatgagtttttccctttagggtatttttgctttaagaaaggaagatacatacatatgtttggaattggtgctagagaccttggtatagatcttggaactgcgaatacgcttgtttttgtaaaaggaaaaggaattgttgtgagagagccgtcagttgtcgctttgcagacggatacgaaatcgattgtcgctgtcggaaatgatgcgaaaaatatgattggacggacaccgggcaacgtggtggctcttcgcccgatgaaagacggcgttatcgctgattatgaaacaacggcgacgatgatgaaatattacatcaatcaggccataaaaaataaaggcatgtttgccagaaaaccatatgtaatggtatgtgtcccatcaggcattacagctgttgaagaacgcgctgttatcgatgcgacaagacaggcgggagcgcgtgacgcgtatccaattgaagagccttttgccgcagcaatcggagccaatctgccagtttgggaaccgactggaagcatggttgttgatatcgggggcggtacgacagaagttgcgattatttccctcggaggcatcgtaacgtctcagtcaatccgtgtagccggtgatgagatggatgacgcgattatcaactacatcagaaaaacgtacaatctgatgatcggtgaccgtacggctgaagcgattaaaatggaaatcggatctgcagaagctcctgaagaatccgacaacatggaaatccgcggccgcgatttgctcacaggtctgccgaaaacaattgaaattacaggaaaagagatttctaacgctctacgcgacactgtatctacaattgtcgaagcagtgaagagcacactcgaaaaaacaccgcctgagcttgcagcagatatcatggacagaggtatagtgttaaccggcggcggagcgcttttgcgcaatttggacaaagtcatcagcgaagaaacaaaaatgccggtcctgatcgccgaagacccgcttgattgtgtagcgatcggaacagggaaagcactggagcacatccatcttttcaaagggaaaactagataatcgggagttcaatagaagaggtgtaacacgatgccgaataagcggttaatgctattacttctgtgtattatcatattggtggctatgattggattttcgctgaagggcggccgcaataccacctggcctgagaaagtgatcggcgatacgacgggagtatttcaaaatatttttcatacgcctgccgaattttttgcaggaatatttgagaacatcaatgatttaaaaaacacatacaaagaaaacgagcatctaagagaaaaacttgacggacagacacaatatgaagccaagcttcaagagcttgaagaagaaaataaatccttgcgtgacgagcttggccatgtcaaatcgattaaagattacaagccgattttagcaacggttatcgccagaagccctgataattgggcgaaacaggtcaccattaacaaggggactcagcaaaacgtagcgaaagatatggccgttacaaacgaaaaaggcgcattaatcggcaagatcaaaagctcgggacttaacaattttacgtctactgttcagcttttaagcgatactgaccgcaataacagagtcgcgacaaaaatttctggaaaaaaaggcagcaaaggctacggcttgatcgaaggatatgacaaagagaaaaaacgtcttaagatgacaattattgagcgtaaggataaacaagacgtgaaaaaaggcgatcttattgaaacatcagggacaggcggtgttttcccagaagggctgacaatcggtgaagtgactgatatcgagtcagattcctatggattaacgaaggttgcttatgtaaaacctgcggctgaccttacagatttaaataatgtgatcgttgttaaccgtgacgtgccgactgtcgatacagaggaggaaggatcgtgaaacgtttccttctccctttcgttatgatgcttgttttttctgcggaaagcatttttacagatttggtgcattttcctttcgttacagatgaccaagtgctcgccccgcgttttttgatgcttgtattgatattcatgtcggcttttatcaaccaaaaacacgcgatgatttacggatttatttttggttttctatatgacatgaactatacaagtctattaggcgtttacatgtttggttttgcagggctatgctatttggcttcaaaagcgtttaaagtgttgcatacaaacgcatttgtagtgatattgatagcagttctggctgtctgtctgctcgaattttacgtattcggcattcagtctttgattcataaagacattatgacgtttaacggatttgtgcttgaccggtttataccgacaattttattaaatattgcagcagctcttattcttgttctgccatttagattgttttttatgagtctaaagaaagaattgagagatgagtaaaaaggattttatctttttttgacgaaatgagtatgttgttgaggtgaatattgtgaagaccaaaaagcagcaatatgtaacaataaaaggaacaaagaatggactaacattgcatctggatgatgcgtgttcttttgatgagcttctcgatggtcttcagaatatgctgtcaattgaacaatataccgatggaaaaggccagaaaatcagcgttcatgttaagctgggaaatcgctttttatataaggagcaagaggaacagctaaccgaattgattgcgtcaaagaaagatttgtttgttcattctattgacagtgaagtcattactaaaaaagaagcacagcagataagagaggaagccgaaattatttctgtttcaaaaattgtccgttcaggccaagtgctgcaggtaaaaggcgacttgctcctgatcggtgacgtgaatcccggcggaacagtcagggccggagggaacatttttgttctgggctcactgaaaggaatcgcgcatgccgggtttaatggaaataatcaagcggtcatcgccgcctctgaaatgcttccgacacaattaagaatcaatcatgtgttaaatcgctccccagaccacattcaaaaagggaacgaaatggaatgtgcttatttagatacagacggaaatatggtcattgaacgccttcaacatttggctcatttaagacctgatctaacaaggcttgagggaggaatgtgaattgggtgaggctatcgtaataacttcgggaaaaggcggagtaggtaagacaacaacatctgcgaacctcggtaccgccttagccattttagggaagcgcgtatgcttagtagatactgatataggactgcgcaaccttgatgttgtaatgggtcttgaaaatagaattatttacgatctggtagacgttgtagagggcagatgcaaaatgcatcaggcgctcgtaaaagacaaacgtttcgatgatctgctctatttaatgcccgctgctcaaacgagcgataagacagctgttgctcctgaacaaattaaaaacatggtccaagagctcaaacaggaatttgactatgtcatcatagactgtcctgccggaatcgagcaagggtacaaaaatgccgtttccggagctgataaagcgattgtggtcactacgcctgaaatctcagctgttcgtgatgctgaccgtattatagggctgctggagcaagaagaaaatgttgaaccgccgcggctcgttgttaacagaatcagaaatcacctgatgaaaaacggtgacacgatggatatcgacgaaatcgtacagcatctgtcgatcgatttgctcggaatcgtggctgatgatgatgaagtcattaaagcttccaatcatggcgaaccgattgcgatggaccctaaaaaccgcgcttccattgcatatcgcaatattgcccgccgcatcttaggtgaatctgttcctttacaggtgcttgaagagcaaaacaaaggaatgatggctaagattaagtcatttttcggagtaagatcttaatgtgatagaatcaaagagaagaatctgacaaagcatatgctgtgtcaggttttttttgtttttacctgctttgttcttgactaaaccgaatatttgccatggacaagacatatgatgtacaaacccaacgaatgcaaaggatgatggcaatgagtcacagagcagatgaaatcagaaaacgattagagaaaagaagaaagcagctttccggctcaaaacgtttctctactcagacagtttctgaaaagcagaaacccccgtcctgggtgatggtaacggatcaggaaaaacatggaacacttccggtttatgaagataacatgccaacattcaacggaaaacacccattggtgaaaacagattcaattatcctgaaatgtcttctgtcggcctgccttgttctcgtttcagctatagcctataaaacaaacattggacccgtcagtcagattaaacccgctgtagccaaaacctttgaaactgaatttcaatttgcctcagcaagccattggttcgaaaccaaattcggaaatccgcttgctttcctggctcctgaacacaaaaataaggaacagcagattgaagtaggcaaagatctgatcgcgcctgcatccgggaaagtacagcaggattttcaggacaatggggaaggaattaaagtcgaaacaagcagcgataagattgatagcgtaaaagaaggctatgtggttgaagtcagcaaagacagccagacgggactgacggttaaggtgcagcatgctgacaacacctatagtatctatggcgagctcaaagatgtggatgttgctttatatgattttgtggataaaggcaaaaagctcggttcgattaagcttgatgatcataataaaggggtctattattttgccatgaaagacggcgataaatttattgatccgattcaggtgatttcatttgaataaatggctcgaccttatcttaaagatccatgtgcatccttttctttggattatcgcggcgctgggcttgctcacaggccatatgaaagcattattatgtctgctcctgattgtattgattcatgagctggggcatgctgctctggctgtgtttttttcttggagaatcaagcgtgtttttttgctgccgtttggcggaacggtcgaagtggaagagcacgggaatcggccgttaaaggaagagtttgcggtcattattgccggacctcttcagcacatctggcttcagtttgccgcctggatgcttgcagaagtctcagtgattcatcagcatacctttgaactcttcaccttttataatctttctatcttatttgtcaatttactgccgatctggccgctggatggaggaaaactgttatttttgttgttttccaaacagctgccttttcaaaaggctcaccggcttaatctaaaaacgtcgctctgcttctgcctgttgctcgggtgctgggttttattcgtgattcctctgcaaatcagcgcatgggttttgtttgtctttctggctgtttccttgtttgaggaatatcggcaaaggcactatatccatgtgagatttctcctcgaaaggtattacggaaaaaacagggagcttgagaaacttctgccgctgacagtaaaggcggaggataaagtctatcatgtgatggccgagttcaaacgtggctgtaagcatccgattattatagaaaaatcaggccaaaagctcagccagcttgacgagaatgaagtgctgcacgcttactttgccgataagcggacgaattcttccatggaggaactgctgctgccctactaaaactgattgacaaacgccttgtattttggtatattttttaatgttatggatgtagcaccattgctacaaccgctcagtacaggtgttaagagcttttacagccccctggtatctggcgagtcttagtctaataggaggtgcagagaatgtacgcaatcattaaaacaggcggtaaacaaatcaaagttgaagaaggccaaactgtttacatcgaaaaacttgctgctgaagcaggtgaaacagttacttttgaagacgttttgtttgttggcggagacaacgtgaaagtcggcaaccctacagttgaaggcgcaacagtaacggctaaagttgaaaaacaaggccgcgcgaaaaaaatcactgttttcagatacaaaccaaagaaaaacgttcataaaaaacaaggtcatcgtcagccttacactaaagtgacgatcgaaaaaatcaacgcgtaagcatgattcaggcaacaatcagaaggtctcatgataaaggcatattgtcttttgaaatgacgggccatgcgaattttgctgaacatggacaagatcttgtttgtgccggagtgacagccgttgtgtttggggccgttaacgcggtcattgtgctcgcgggcttcgagccgcttcttgatatagaggaggacgggggttatttttattttgaattccctgaatctcttgatccagaggcacgccaaaaagctcagctgctgattgaaggcatgattgtttcgctggagacaatcgaacgggattacaaagacaacttgcgtgtgaccacaaacataatataggaggtgagctacatgcttagattagatcttcagtttttcgcttctaaaaaaggagtaggttctacaaagaacggacgtgactctgaggctaaacgtttaggtgctaaacgtgctgacggtcaattcgtaacaggcggttctatcctttaccgtcaacgcggaacaaaaatttacccaggtgaaaacgtgggccgcggcggagatgacactctatttgcgaaaatcgacggaactgttaaattcgaacgtttcggccgtgaccgcaaaaaagtgagcgtatatcctgtagctcaataatgattcaaaaaactccggtcgatgatgactggagttttttttgcaatatgcggagtaaacacctagaatgaaatgcagagtatgtgcgagcagaccccgccaagaatgagaataaacatctcaaacccactggatatgttccccaagcagtaatacataaaatgttctgcctggctgcaaatcaaccaaagccagaaaaaaggaacatgatatttctgggaaaaacaattgtttttctaacaaagccttctctgttataattcataatacacacttatacagactcctaaataagaaattaaatgattgggagtgcgaaaatgaaggatgtttcaaaaaatcaagaagaaaatataagcgacacggcattaacaaacgaactgattcatctgcttggccattcccggcatgattggatgaataagctgcagctgattaaaggaaacttaagcttacagaagtatgaccgtgtctttgaaatgattgaagaaatggttatagacgcaaagcacgaatcaaagctctcaaacctgaaaacaccgcatttggcgtttgattttcttacgtttaattggaaaacccattatatgacgcttgaatatgaagttctcggagaaattaaggatttgtcggcttatgatcaaaagctggcgaaactgatgagaaagctgtttcatctgtttgatcaagcagtcagcagagagagtgaaaatcatttaacggtttcgcttcaaacggatcatcctgacagacagctgattctgtaccttgattttcacggcgcctttgccgatccatctgcttttgatgatattcggcagaatggatatgaggacgttgatatcatgcgttttgaaatcacgagtcacgaatgtctgattgaaattgggttggactagcggagtttttaacggtttagaacggaggacattatgtttgtagatcaggtcaaagtatatgtaaaaggcggcgacggcggcaacggtatggttgcgtttcgccgtgaaaaatatgtgccgaaaggcggccctgccggcggagacggaggaaagggaggagacgtcgtttttgaagtagatgaaggtctccgcaccctgatggattttagatacaaaaaacactttaaagcgattcgcggcgagcatggcatgtccaaaaaccagcacgggcgaaatgctgatgatatggtcattaaagttccgccgggcaccgttgtgacagacgatgatacaaaacaggtcattgctgatttaacagagcacggacagcgggctgtcattgcaagaggcggaagaggcggaagaggaaatagccgctttgctacaccggctaatcccgcgcctcagctttcagaaaacggcgagccaggaaaagaacgctacattgttcttgaattaaaagtgcttgcagatgtcggacttgtcgggttcccgagtgtgggaaaatctactttgctgtctgttgtctcatctgcaaaaccgaaaattgcggactatcactttacaacgcttgtcccgaatctcggcatggttgaaacggatgacggacgcagctttgtcatggctgatttgccagggctgattgaaggcgcacaccaaggcgtcggacttggccaccagtttttgcgccatattgaacggacgagggttattgttcatgtcattgacatgtcaggcttagaaggccgtgatccatatgatgattatcttacgattaaccaggagctgagcgagtacaatctgcgtctcactgagcgtccgcaaattatcgttgcaaataaaatggacatgccggaggctgcggaaaatctcgaagcctttaaagaaaagctgacggatgattatccggtattcccgatcagtgcggtgacaagagaaggtctgcgtgagcttctgtttgaggttgccaatcagcttgagaacacaccggaattcccgctgtatgacgaggaagagcttacacaaaaccgtgtcatgtacacgatggaaaatgaagaagtgccatttaacattacacgcgatccagacggtgtatttgtgctttcaggagacagccttgagcggttattcaagatgactgatttctcacgtgatgaatcggttaaacggtttgcaagacagatgcgcggaatgggtgttgatgaagcactcagagaacgcggagccaaggatggagatataatcaggcttctggaatttgaatttgaatttattgattaatcaatgttggctgaaaagagagcctggtgccaggctctctattttaaaggggggatgcaaatgaaagaggagacattttatcttgtccgtgaagatgtattgcccgatgcaatgagaaaaacattagaagtcaaaaagctgcttgatcgaaaaaaagcagattcagtagcagatgccgttcaaaaggtcgatttaagcagaagtgcgttttataaatacagggatgctgtttttccattctacaccatggtaaaagaacaaattatcacacttttctttcatttggaggataggtcaggtgcgttatctcagcttcttcaggcggtagctgattctggaagcaacgttctttccattcaccagaccattccgcttcaaggcagagcaaatgtgacactgtctatcagtacgtcggcaatggaagaagacattcatacattaatgaataagctcaagaagtttgattttgtagaaaaggttgaaatattaggttcaggtgcataagggagagaaaatcgtcatgaaagtcggttatttaggtccagcagctacatttacacatctagcagtcagttcttgttttcaaaacggcgccgaacatgttgcttaccgcaccattccggagtgtatagatgcagccgttgcaggcgaagttgattttgcttttgttcctttggaaaatgcattagaaggatctgttaatctaacaatagactatttaatacatgaacagcccttgccaatcgtgggtgaaatgacgttgccgattcatcagcacttgctcgtccatccctctagagagaatgcatggaaagagctcgacaaaatttactcacattcacacgcgattgcgcaatgccataaatttcttcatcgacattttccttccgttccatatgaatacgccaattctaccggggcggcagcaaagtttgtcagtgaccatcccgagctgaatatcggggtcattgccaatgatatggcagcttctacatacgaattaaaaatcgtgaaacgggatatacaggattatagggacaatcatacaagatttgttatcctgtctcctgatgaaaacatatcttttgaagtgaattcaaaattgagttctaggcccaaaacgaccttaatggtcatgctgccgcaggatgatcagtccggggcgctgcatagagtgctgtctgcattttcttggaggaatttaaacttgtcaaaaattgagtcacgtcccactaaaaccgggttaggccattatttctttattattgatattgaaaaagcgtttgatgatgtattgattccaggggccatgcaggagcttgaagcgctcggctgcaaagtgaagctcctgggtgcataccagtcttaccaattataaaaaagccctctagagggctttttttagtctttaattaaaatgccggcttcttcgagggcttgacaagcttgatcgatgcgatgttcatcaggtgctgtcagtgtatgcaggtgcacgccgtcggtcagctgtgataagtaggcagcattcgtagaattgattttttttatgaaatggctaacttccttccgggtgcctacttggatggctgcagttaaatctccatacacgggatgctcgatttttacgtcttttactgtaacgccttcgtcgacgatgagctgcagttcctcttctgtccgttcaggaccgtgcagacatgctatgattctttctgcctgctggtgctgctgagcggctgcatccatgtatacatatccttggcttgtggcgataatcggtacatttttcgctttcaagagcgatatatcctgtacaataacctgtcttgaaacgttcgctttttttgcgagttctcctcctgtcagcggtgatttagattccttcagccacagaagaagctggtcacgcctgttggcgcccattagctttaattcttcggtcaatatcaaattctcctttcttttgttcccaaagcactgtaaacgtatgtaataactgttccagctgttcagctgttgtatgcctgccaaaagagatgcggataaattgcagagcttcttgttcggtttttcttaatgctttcattgtttcagacggaccgtggtaacctgcagaacaagcgctgccggttgaaatgcaaatattactccgattacattctaacataacatattgtccttcaaatgagtgaaaaaaacaccctataatatgcggaagacattctgcttgcgaagtgtctgccgcaagggttacagggagagaccgaatacggatttggtctagaaagtatgttcttaatgcctcattgcgggatatctgtttttctatttcgcttacgatcaattctgcagcggcagtgaaggcaccgatcccgggaacatttacggtgccggctctgaatccgtattcgtgagtagtcagaggataaacgggtttccaagggacatccggacggatatagaccgcccctactccttttggaccgtggattttatggctggacattgagagtgcatctactcccagattttttgtattgatcgggatctttccaaacgtttgaacagcgtcgcaatgaagaagaatgcccttattgtgcaggtatgaagataggcggtgaatgggctgaatgatcccggtttcagaatttgcatgctgaatagatacaaggcctgtttccggccggatatgggctagtaatatttcctcggtaataagcccgtattcattcggttcaatgactgttacatcatatccctgctgttccaaaaaagcagtgcaattatgaatggactgatgctccatggcagtcgtaataaaatgtcttttcgtttttggcaggccgtttagcaatgattgaatggccagaaaattggattcagtgccgccgcttgtaaaatagatgccgcttgcttctccgccaatgatgttggcgattttttcacggcagtactccagtatgtgctttgcttttcctcctgcatcatgcaggctgctggcatttccgtacatatccatactaagcttctgatatacagtaagggcttcctcacaaataggcgttgtcgctgcataatctaaataaatcatccggtcttcctccatccgttctccataaaaaactcttgagtttattttatccttgtgtaaatataggtgtcaagacaggtgtaaacaacaggaggatggcatatgtctaaaaagacgattgcagtcatcggttcaggggcggcggcactttccttagctgcagctttcccgccctcatacgaagtgactgttatcacaaaaaaaagcgtcaaaaacagcaattctgtctatgcacaaggcgggattgctgcggcctatgcaaaagatgactcgattgaagcccatctggaggatacgttatacgcagggtgcggccataataatctagctattgcagcagacgtattacatgatggaaaaatgatggttcaaagcctattggagcgtggatttccattcgaccgcaatgaacgaggcggtgtttgtcttggaagagaaggggcccactcatacaaccgcatatttcatgcaggcggagacgcaacaggcaggctgcttatcgattatttgctcaaacggatcaacagcaaaatcaagttaatcgagaatgaaacggcagcagatttgcttatagaggacggacgatgtatcggcgtcatgacaaaagacagcaaagggcggctcaaggtaaggcacgcagacgaagttgtgctggctgccggcggctgtggaaacctgtttcttcaccatacgaatgatcctactgtcacaggtgacggtctttctctcgcttaccgggcgggggcggaattaacggatttggagtttactcaatttcacccgacactgcttgtgaaaaatggtgtttcctacgggcttgtttcagaagctgtcagaggggaaggcggatgtttagtagacgaaaacggccgcaggattatggctgaacggcatcccttaggtgacctggctccaagagatattgtctcacgggttattcacgaagaaatggcaaaaggaaatcgcgtttatatagacttcagtgcgatttctgattttgaaacgcgtttccctaccatcaccgctatttgtgaaaaagcaggggttgatatccaaagcggaaaaattcctgttgctccgggaatgcatttcttaatgggaggtgtttcagttaatcgctggggagaaacgacagtgccggggctttatgcgattggcgagacagcatgctccggtttacatggagcaaaccggcttgcaagcaattctttattggaagcgctggtatttggaaaaagggcagcagagcatattatccaaaaaccggtttataacaggcaatatcaatcaaggctagaaaccagtgtcgtctacgaggtgccggatatagaggtgcatgaactgcaaagcaaaatgacaagccacatgtctattctgcgggaacaaagcagtttgattgagcttagcatctggcttcatacgctgccttttcaggaagtaaatgtgaaggatatcacaattcggcagatggaactttctcatctatggcaaactgcaaagctgatgacgttttctgcgcttttgcgggaggaaagcagaggggctcacttccgcaccgattttcctcatactgaggtgagctggcaaggaagacaaattgtccatacaaaaaaaggaacgaagatcagaaaaaacgaggggatttggaacaatgaatcatttacagctgaaaaaattactgaatcacttttttcttgaggatattgggacaggggatcttacatcgcagtctatttttggagaacagagctgtgaagcggagattgttgcaaagtcagagggtatttttgcaggagcagcgatcataaaagaaggcttttcgttattggacgaaaatgttcaaatcattttacacaaaaaagatggggacatgttgcataaaggtgaagtgattgccgagttacacggtcccgcagctgcgctcctttcaggagagcgggtcgtattaaatcttattcagaggctgtcaggaattgcgacaatgacaagagaggctgttcggtgtctggatgatgaacagattaaaatttgtgacacgagaaaaacaacaccggggctcagaatgctggagaaatatgctgtcagagccggcggcgggtataatcatcgattcggtttgtatgacggcatcatgattaaagataatcatatcgcagcatgcggttctattttagaggcgtgcaaaaaagcccgtcaggccgcgggacacatggtaaatatcgaggtggaaattgaaacggaggaacagctgcgggaagcaattgcagctggcgcggatgttattatgtttgacaactgtccgcctaatacggtccgtcattttgcaaagctcacaccggatcatataaaaactgaagcctccggcgggattacgttagaatctttgcctgcttttaaagggacgggtgtgaattatatttcattaggatttctgactcattccgtcaaaagtttagatatcagcatggatgtttcgttatcaaatgaatctgtggaggaatgccgttatgtcaattcttgatgtgatcaaacaatcgaatgatatgatgcccgaaagttataaagaactatcgagaaaggatatggaaacgcgcgttgccgccattaagaaaaagttcggcagcaggctctttataccaggccatcattatcaaaaggatgaagtgatacaatttgctgaccaaacaggcgactccctgcaattggcccaagtagcggaaaaaaacaaagaagcggattatatcgtattttgcggcgttcactttatggcagaaaccgccgatatgctgacaagcgagcagcaaacggtcgtcctgccagatatgagagctggatgttctatggctgacatggctgacatgcagcagaccaatagggcatggaagaagcttcagaatatatttggagatacgatcatacctttaacttatgtgaactccactgcggagatcaaggcattcgtcggaaagcatggcggagcaactgtaacttcttcgaatgcgaaaaaagtgcttgaatgggcgtttacacagaaaaaaagaattttatttttgcctgatcagcatttagggagaaatacggcttatgatctgggcattgcgcttgaagatatggctgtgtgggatccgatgaaagatgaattagtagctgaatccgggcatacgaatgtgaaagtgattttgtggaaagggcattgctctgttcacgagaaattcaccactaaaaatatccatgatatgagagagcgagaccccgacattcagatcattgtgcacccggaatgttcacacgaagtcgtgacactaagcgatgataacggatcaacgaaatatattatcgacacaatcaaccaggctccggcgggaagcaagtgggcaatcgggacagaaatgaatcttgttcagcggatcattcacgagcatccagataaacaaatcgaatcactcaaccctgacatgtgcccttgcctgacaatgaaccgaattgatttgccgcatttgttgtggtcgctggaacaaattgaaaaaggagaaccttcaggcgtcatcaaggtgccaaaagccattcaggaagatgcactccttgccctgaatcgaatgctttcgatcacgtagatcagaaatattttcccttcctttactcataacttcttttgttcaggcatatgttgtgaagaaacatattgtaatcacagctgaactgttcacgttttgcataggaggggaaaacgttgaaaatccatatcgttcaaaaaggcgattcgctctggaaaatagctgaaaagtacggagtcgatgttgaggaagtgaaaaaactcaatacacagcttagcaatccagacttaatcatgcctggaatgaaaataaaagtgccgtcagaaggagtcccggtcagaaaagagccaaaagcgggcaaaagtcctgcggccgggagtgtgaagcaagaacatccatatgcgaaagagaagcctaaatccgttgtcgatgtagaagacacaaagccgaaagaaaagaagtccatgccgtatgtcccgccgatgcctaatttgcaggaaaatgtgtaccctgaagctgatgtgaacgattattatgatatgaaacagcttttccagccttggtcgcctcctaaaccggaggagccaaaaaaacatcatgacggaaatatggatcatatgtatcatatgcaagaccaatttccacaacaggaggctatgagtaatatggaaaatgctaattatccgaatatgcctaatatgccaaaggcgccagaggtaggcggtgtagaagaggaaaacgttcatcacacagttccgaatatgccgatgccggctgttcagccttattatcattatccggctcatttcgtaccgtgtccggtgcctgtttcgccaattcttccaggatcaggattatgctatccgtactatccggcacaggcttttccaatgcatccgatgcatggataccagccaggctttgtatcgcctcagtatgacccgggttatgaaaaccagcatcatgaaaacagccatcacggacattacggttcatacggtgcgccgcaatacgcatctccggcttatggatctccgtatggacatatgccgtatggcccttattacggcactccccaagtaatgggagcataccagcctgctgcggctcatggttacatgccatacaaagatcatgacgactgcggctgtgacggtgatcatcagccatatttctctgcacctggccattcgggaatgggagcttatggaagccctaatatgccatatggcacagctaacccaaatccaaacccatattcggcaggagtttctatgccaatgacgaatcagccttctgtaaaccaaatgtttggccggccggaagaagaaaatgagtgatcgttcggaacgatgtaaatcgttcctttttttgttttcaagcagatcactgccaaatggagagaactgacacgcttaacatgccccccatacgcacatgataaaagcgagcaaacatgctcaattcgtccacggggggtttttccattgggtaaaaaaatgacgatcgctagcttgattctaatgacagccggcttaacagcatgcggagcaaacgataatgctatgaatgatacgcgcaataacggcaatacccgtccaatcggatattatacaaatgaaaatgacgccgatagacagggagacggaatcgaccacgatggtcctgtttctgaattaatggaggatcagaacgacggtaaccgaaacaccacgaatgtaaataaccgtgaccgtgttactgctgacgatcgtgttcctttggcaactgacggaacatataacaacacgaataaccgaaacatgaatcggaatgcagcgaacaacgggtatgacaaccaagaaaacagaagactggctgcaaaaattgccaaccgtgtgaaacaagtgaaaaacgtcaatgacacacaagttatggtatcggatgaccgagtagttatcgcagtcaaaagccacagagagttcacaaagtctgacagagataatgttgtaaaagcagcgcgcaactatgcaaatggccgtgacgtccaagtatcaacagataaagggctgttcagaaaacttcataaaatgaacaaccgctaggaaggaagggctgccggaagtgatattcggcagcctttttctttgcatcagcgaacaattcccattaaagtgtacatagaaaatgtaaaagaaggtgaaaacatggcaggccattccaagtggaaaaacattcaaaaaagaaaaaatgcacaggatgcaaagcgcgggaaaatatttatgaagctggcaaaagaaatctatgtggcagcgaaagaaggcggagcggatccagaagcaaattcagcattgcgtcttgttatcgaaaaagcaaaaggcgccaatatgccgaatgaaaatatagatcgggccattaaaaaagctgcgggaggccaagatggaagcagttatgaagaaatcacctatgaaggctacggcccttcagggattgccgtgatggttgaatgcgtaacagataataaaaaccgaacggcgtcaaatgtgcggacagcctttaataaaaatggcggaagtctgggagaaagcggatgtgtagcctttttatttgaacggaaggggttcattacgatagaccgcactgaacggcaaatagaagaagatgagctcatgcttgatgtgcttgaagcaggaggagaagagctgcgaattaaagaagacctatatgaggttttcacagagcctgagcattttgaagaggtgaaaacagccctcgaatcgaaatatccaatttcttcggcggaggtgaccatgcttcccaatacctatgcagatgccgatgatcaggctgttgagaagctggaaacattaatagacgtccttgaagatgacgatgatgttcaagaagtgtatataaactatcgttcataaaaaaccggcacgaggtcatatcgggccggttttagtatgttcaggagacacgttcactttcatgagtgtattctttctcccagaaatcagcgtttttgatacccagcgcttttggatcaaagaccgggtctaagccctgctttttttggcgctcataatcctttaaagcaagaagcgccggtttggccagcagcacaatggcaatgacgttcagccataccataatgccaagccctgcatcccctaatgcccaagcaagcgaagctgttttcacagtaccatagaatgtggcggctaaaataatcagttttaagccaagcatcgcccatttgctttctctgcctcgtgctaaataggcgatatttgtttctgcgatgtagtaatacgccataattgttgtaaaagcgaagaagaataaagcgatggcaacaaagcctgcaccgaatccgggaagaacactgtcaattgccgcttgtgtgaaaccaggtcctgcttctacgcctttaagctggtgaacgataaaggaaccatctgcagcctgggtattgtacatgccggtaaacaagatcatgaaagctgtagcggaacatacaaacaaggtgtcaatataaacagaaaatgcctgaaccagtccctgcttgaccggatgagaaacttctgcagcagctgccggatgcgggcctgttccctggccggcttcgtttgagtaaatgccacgtttaacgccccaggaaatcgccatgccgatcaagccgccaaaagcggaatccaatgcaaaggcgcttttgaatattaatgagagcacagcaggtaattcagacacattcatgacaataataatcaaagacagcaggatatatccaatggccataaatggaacaatcatttgcgccgcactggcaattcgtttgacgccgccaaaaataataaaccctaataataaaaccagaccgcaccctgtgacgaaaggagagatgccgaatgcattttggatcccagccgcaatggagttggactgtacgcctggcattagaaaggccatcgcaataagggcagcagcggcaaataagacggcaaaccacttaatgcctaagcctttttctatataataagcagggccgccccgatattgaccgtcttgtttcactttgtaaatttgagcaagtgttgattctacaaaggcactcgccgcaccgataaaggcaatcgcccacatccagaacactgcaccgggtccgccgaatgcaattgctgtcgccactcccgcgatgtttcctgtgcccacacggccggacagcgcaatcgataacgcttggaaagatgaaacgccggcttcagagctcttgcctttgaacatctgaacaatcatttcttttaaatgtcggacttgtaaaaaacgggtcataattgaaaaggcgaatccaattcccaataaaatataaatgacgggcgtactccataagaccgcattcaaactagcaacaaaatctgccatcaagcttccccctcacttcaaattcgaatacatgtataaaaaggattttggtctaatcgaactatttctacaatcgatttgtcacattatatgacctgtaattatcaataagaagaggaagggaaaaagaaaaaacgcggcgtatcgactacgctgcgtttttctacagaggcaaacttatggcaattgttataaaatccttcagcaacaaatagcctagttcagtcaaaccgtatataaaggataaagcaatcacaaaatgattgaaatgcttgtcatcatttgttccgttcatcttattcatgtttcatcacctcactgacgcctgcggcggttcttcacggatccaatgatcatcttttcgccaatcatacgtttcaccagtatcaagatgtaaagtctgattgccgattttcactgtattgtgattgatccacgtcactgctgggcggctgtccgggtaattccagtagattgttctcttgacaagtgttttttcatttacaagttcacctctggctgcatctaagctcaaggtgttttcggatacataagtgtttaacgtatagctgccgtccggcgattcaaccgattggaagagatttcctttcggaacgctttttagtgaaaataacatccaatagatggcgccgccgaagaagaccagcagggcaaacataataagcgggatgttgctgcgtgtcttaatgtgactctctccctttttttctctcattttactatatatcggattcatatgatctttacatttctttaaaattaccttaataaagcaatgataagatgaaataaagccaataaagggtgaggggagacagaaatggaaaaaacgtattgtcattccggcgagaaggacccagaagcggtctacttaactgtgagaggctatcgaattaagctgtcgcctgaacaaatgaaactgatttctgccgtcagaaagtaaaaaatacatgataaaggcagccgcttgtgcggctgcctttttgatttaagaatattttcttttccgctgtgcgaaatgcttttgaaaccaatctttcttatataaaaatgcgatgatctccagccaaaaacccggaatctttttggggaatatcggttttttgtagagtgcatgatatgcggattttaagtcgtcccactgcgtgcatgtttttgtctgctcaaatctcgcaacatcaatcacccgcaccgccccggtttctgtcaatatcagattccgcaaatgaatatctgacgggttcagtccggctgcccgggcgtcagaaagcgcttcttcaacctgctgaatcatgtcatcactgattgcaatgcctttcttcagacagttataaaaggtttcacctttaatatattccatgagaataaatgaatcgccagtttcgtaaatgtcaggatagaatgcggacccggctaatttttcatagatcgctgcttctttgactgctgtcgcttgatattccggaaaaaatactttcagcgccatttttcgaccgccttctgttaaggcaaacacataggcgcttcttcccttgccgattagtgttaattcctcggatttctctttgactttatcaaatctgctgttcttgcggtatatgacggtatgggccagtgcctctgcttttgtcagcatttcattcaccttctttgctctattttatgcagctgtttataggaaaatcataaactgttcaggaaaaagagcctaattctagtgtatctggtcttgaagaagaaggctacttataagcatgaattgtgataaaagagacatagaacgtttaatttccattcttgaaaagcgcttacaaatgggatagtattaattttaaataaagcgctttcgtgaatgatcaagggggaagaagccatgacaaaacagattgtaacagggattatcggtgcaggccgcatcggcaaacttcatgttcaaaatataagccggattcctcacatgaaaataaaagcagtctctgacattcaggcaagccgtataaaaagctgggccgacagtcatcagattgaatacataacctctgattatcgtgatttattacatgatcctgatattgatgctatttttatttgctctcctacagccgtacatgcacagatgatcaaagaagcagccgaggcgaaaaagcatatattttgtgagaagcccgttagtttctctctggacgaaacgagtgaagcgcttgcggctgtccggaaacacggtgtaacacttcaagtcggatttaaccgccgctttgatcctcattttaagaaaatcaaaacgattgttgaaaatggtgaaatcggtacgcctcatttattaaaaatcacttctcgggacccagaacccccgaatatagattatgtccgtacgtcaggcgggttgtttatggatatgtcgatccatgattttgatatggccagatatattatgggaagcgaagtgacggaagtgtatgccaaaggggcggctttggtgaatccttcttttgcggagctgggtgatattgatacagctgttattacactgacttttgaaaacggtgccatggctgtgattgataacagccgccaagctgtgtacggatatgaccagcgggttgaggttttcgggacgaagggctctgcagcggctgacaatagcaggccgacaacggttgaggtgtcaacagctgattttgtgatgaaggataaaccgcatttctttttccttgaacgctataaggattcatatgaggaggagattctccgttttgcagaagcgatcggcacaaaccaggagactccctgcaccggcaatgacggtttacaggccggaaggatcgccagagcagcacagcaatcgcttgcttttggcatgcctgtcagcattgagcactctgaaaaaatcgctttttaatctaacaggattacaattcagcaagcttgggtatatactccattgatactttaagtaggcggtggagaaaatgaatacagtacatgctaaaggaaatgttttgaacaaaatcggaattccttctcacatggtttggggttatattggcgttgtcatctttatggttggagacggcctcgaacaaggctggctgtctccttttctcgttgatcatggtctcagtatgcagcaatccgcatcgttatttaccatgtacggcattgctgtcaccatctcagcttggctttcaggaacgtttgtccaaacttgggggccgagaaaaacgatgactgtcggattgcttgcatttatcctcggttcggccgcttttatcggctgggcgattcctcatatgtattatccggctctcttgggcagctatgctcttagaggcttgggatatccgctgtttgcatactcttttctggtatgggtgtcatacagcacctctcaaaatattctcggaaaagccgtcggatggttttggtttatgtttacgtgcggccttaacgtgctgggcccgttctattccagctatgcagttccggcctttggagaaatcaatacgctttggagcgctttactgtttgtggcggcaggcggaattcttgccttattttttaacaaagataaatttactccgatacaaaaacaagatcagccgaaatggaaagaactgtcgaaggcatttacgattatgtttgaaaaccctaaggtaggcatcggcggagtggtcaagacgattaatgcgataggacaatttggatttgccatctttcttcctacttatttagcacgatacgggtattcggtttcggaatggctgcaaatatgggggacgctgttttttgtgaatattgtgtttaatatcattttcggtgcagtcggagataaactaggctggcgcaatacggtcatgtggtttggcggtgtcggatgcggtatttttacgctggcgctgtattacacgcctcagctgatcgggcatcagtattgggtgctcatgattatcgcctgctgctacggcgcggctttagcagggtacgtcccattaagcgcgcttttgccgacgcttgcacctgataataaaggtgctgccatgtcagtgttgaatttgggatctggtttatgtgcgtttatcgcgccgggcatcgtgagtcttttcattgggccgctcggtgcaggcggcgtgatttggatctttgcggcattgtattttttcagtgcctttctgacgcgattcttgacaatttctgagcaaagcacagatgtgtatacggaggaacggtttgtcagggaaaatgtgcagacaaattttgataaaacggttaagcagtagcctctttggtcaaactaatcataaacgtgtgcaaagaggtgtagagggtgaaacgattcagcacggcgtatcttttgctgggcattctttgctcagcggcagtatttttaataggagctccttcccgcgcacttggcgcggaagtggagcactatgagccgctgcaggtgcatgtgcagcttgaaaaggtgtatttggacggcgatgtcagcattgagcataagcatgaaaaagtgttttctatggatgatttttgggcagcttatgccggatggacgcttgtggaacaaaaaaagggatatgtgctcttccggaagcaaatggacgatatttctccgctcagcaaggtcaacgggtatatcggtgtatcggataatggagtgatttctacttttcatgggcggcctgagccagcttccgaaccaattcagtctttttttcaaattgatttagaaaggctggaaagccatatgcaaaaaaatctgctgaaaggcattccatttcggacaaaagcggagtttgaggatgtcatcgaacatatgaagacatacagcgggtaacgtccgctgattgaagacatgtattcatgtcttttttttcgtgaaagaatgagagagaagcgaacatatgttaacttttctataagactttggctgtttttatggtacaatgaagaacagtcaaagaggtgaatttgcgtgattgaatttgttaaagggacgattgattatgtatctccccaatatattgtcatagagaacggcggcatcggctatcagattttcacgccgaatccgtttatatataaggagagaagccaggaaacgatttttacataccatcatatcagagaggatgctttttcgctttacggtttttcaacaagagaggagaaggcgctctttacaaagctgttaaacgtgaccggaattggcccgaaaggagcacttgccatcttgggctcgggtgatcccggagcggtcatccaagcaattgaaaatgaagatgaagcttttttggtcaagtttcctggagtaggaaagaaaaccgcacgccagattattctagatttaaaaggaaagctggcagatgttgtgcctgaaatgattgaaaatctgtttaatcatgaagaaaggcttgaaaagcaaacagcggaaacggctcttgaagaagcacttgaagccctcagggttctcggatatgctgaaaaagaaatcaaaaaggtgcttcctcaccttaaagaagaaattgggctgacaacagaccaatatgtgaaaaaagcattacaaaaactattaaagtaaggtgatgttcatggatgaacggctcgtctcaagtgaagcagacaaccatgaatcagtgatagagcaaagcctgaggccgcaaaatctggcacagtatatcgggcagcataaggtaaaagaaaatttgcgcgtgtttatagatgcggcgaaaatgagacaggagacgctggatcatgttcttctgtacgggccgcccggactcggaaaaacaacgcttgcttcgattgttgctaatgaaatgggagtggaattgcggacgacatcagggcctgcgattgaaaggcctggtgatttggctgctatattaacggcgctggaaccgggagatgtattatttattgatgaaatacataggctgcacagatcgatcgaagaggtgctttatcctgcaatggaagacttttgcctggacattgtgattggcaaaggcccatctgcccgctcggttcgcctcgaccttccgccttttacgctggtgggagccacgacgagggtggggcttttgacggctcctttaagagacagattcggcgtaatgtctcgccttgagtactatacacaagaagaactggcggatattgtcacaagaaccgctgatgtattcgaggttgagattgataaaccgtcggctcttgaaattgcaagaagatcgagagggacgccccgcgtggcgaaccgcctgctgagaagggtgcgcgatttcgcccaagtgctgggtgacagcaggattacggaagacatttctcagaatgcgctggagcggcttcaggttgaccgcctcggtttggatcatattgatcataagctgctgatgggcatgatcgaaaaattcaacggcggcccagtaggccttgatacgatttcagctaccatcggcgaggaatcgcatacgattgaagacgtatatgaaccatatctgctgcaaattggatttatacaaagaacgccgcgtggaaggatcgtgacaccggccgtttatcatcatttccaaatggaggctccccgatatgactgaatttcctaagatcattatgattcttggtgctgttttgcttattatcggagcagttttgcattttgtcggcaagatgccgggagatatttttgtaaaaaaaggaaatgtcacgtttttcttcccggttgtcacttgtattattataagtgtggtattatcaattttgcttaatctttttggcagaatgaaataacaaaagactagaataaaggtgaaatcatcatgaaagtcgatttatttgattttgaactaccagaacgtttaattgcacaagtaccgttggagcagcgtgatgcttcaaggctgatggtgctcgataaacatacaggagagcttactgacagctcgtttaaacacattatcagcttctttaacgaaggcgattgtctagtcctgaacaatacccgggtactgcctgcgcggttattcggcacaaaagaggataccggcgcgaaagtggaacttcttttgttgaaacaggaaaccggtgataaatgggaaacacttgccaaaccggcgaaacgggtgaaaaaaggaactgttgtcacatttggagacggaagattgaaggcaatctgcacggaagagcttgagcacggcggcagaaagatggaatttcaatatgacggtattttctacgaggtgcttgaatcccttggagagatgccgctccctccatatatcaaagaacagcttgatgacaaagagcgctaccagacagtgtattcaaaagaaatcggctctgctgctgcgcctacagctggccttcacttcacggaagaaatcttacagcagctgaaagacaaaggcgtgcaaattgagttcatcacactgcacgtaggccttggaacgtttcgccctgtgagtgccgatgaagtggaagagcataatatgcatgcagagttttatcaaatgtcagaagaaacggctgcagccttaaacaaagtaagagaaaatggcggtcggatcatttctgtcggcacgacctcgacacgcacgcttgagacgattgccggggaacatgacgggcaatttaaagcatcaagcggctggacatctatttttatttatccgggctatgaatttaaagccattgacggaatgattacaaacttccatttgccgaaatcgtcattgattatgctggtcagcgcgcttgctggaagagaaaacattctgcgtgcctataaccatgcagtggaagaggaataccgtttcttcagcttcggagacgcgatgctgattatataatttgagaacaggaggcctcatcaaaagtggctgaacaaccaatacgctatgaatttataaaagaatgcaaacaaacaggagcgcggctgggcaaagtgcatacgcctcacggctccttcgaaacgccggtttttatgccggtcggcacactggcgacagtcaaaacaatgtcgcctgaagagctgaaagcaatggatgcaggcatcattttgagcaacacttatcatctatggcttcgtccgggccaagacattgtcaaagaagcgggcgggctccataaatttatgaactgggaccgcgcaattttaacagattcaggcggttttcaggtcttttctttaagcaagtttcgtaatatagaggaagagggtgtccatttccgcaatcatctaaatggagacaagctgtttttatctccggaaaaagcgatggagatccaaaacgcactcggctctgatattatgatggcgtttgacgaatgcccgccatacccggcggagtacgactacatgaagaggtcagttgaacggacaagccgctgggcggaacgctgcctgaatgcccacaatcgtcaggatgaacaagggctgtttggtattgtacaaggcggagaatatgaagatctgcggacacaaagtgcgaaggacttgatttcgcttgattttccgggatatgctataggcggattgtctgtaggtgaaccgaaggatgtcatgaaccgtgtactcgaattcacaacaccgctcttgccgaaggataaaccgagatatctgatgggagtaggttctccggacgcactgatcgacggagcgatccgcggggtcgatatgtttgactgtgtgctgcctacacggattgcaagaaacggcacagtgtttactgctgaaggacgactcaatatgaaaaatgcgaaatttgaaagagacttccgtccgattgatgaagagtgtgattgctatacatgtaaaaactacactcgcgcgtacattaggcacttgattcgctgcaatgaaacattcggccttcgattaacaacttaccataaccttcattttctgttacacttaatggagcaggtaagacaggctattcgcgaggatcgtctgggtgatttcagagaagagttctttgagcgttacggctataacaagccaaatgcgaaaagcttctaaataaacataacaggcttacagaaaggggtgaaaatgatgactggcactttaggtacattggttcctattattttaatgtttgcggtcctttacttcttgctgattcgtcctcagcaaaagcagcaaaaggctgtacgccaaatgcaagaggaactgaaaaaaggcgattcagtagtgacaatcgggggattgcacggtactattgactctatcgacgaaagcaaagtcgtaattaagactggtgataacacacgtcttacgttcgaccgccgcgcgatcagagaagtttctgctgctgaataacagcaggagctatacatagcaaacaaaaaagagcgggcaagtgagcccgctcttttttatgtggaagacctgtttcccctcatgttcacgccgaaaatcccgcccagcatgcacacccctaaaaatcccagatggaagatcagctgttctgctgtaaatgtctttccgaatcctaaatactgaaacaataagataatcagagaaaaacttaaggcagtcaatgctccaatcatccagcctctttccttgcctttcccgcctgaaatgaacccgccgataaataaagagagaaatgagatagctgtgatcagccagttaaatgatgattcttccagcgaggttgcggtcaataaaagtgaaaccgccaaacttgtcaggagcatggctgcaaatatggcgattaagccgtaaagaatgccttttccaacttgtttcgtctcctccatgattgtctcctttctgcctgtattaaaaggcttctgttctttttgcacaaagccgtcagacatgctgatggctcgtctttgtaaaaatgtattcccttatcccatgaattagacgtaaaagctttgtgaaatgcaatcggtttttcttacataaattgatcattttgttgcaacctataatgagttggaggtgcatgatggaagagcttctcactattgcgtttcgcacagtcgtattgtattttgtgatattgatcatttttcgtctcatgggcaagcgggagatcggagagcttagtatattagatctcgttgtctttatcatgatggctgaaattgccgttttagccatagaaaacgtagacgatcatctatttcataccattttgccaatgcttgtattaatgatcattcaagtgactttggcatacttttctttaaaaaaccgaaaagtccgccagcttcttgacggtaagccgaccataattatcaaatatggaaaaattgacgaagacgccatgaaatcacagcgttataattttgatgatttaatggttcagctcagagaaaatagcatcgacagagtagctgacgtatcatttgctattttagagccgtcgggcaaactgactattgttaagaaagaaaacagcggagagcatcgacagctcgaaatgccgctcattatagacggcttcattcaaacagaaaacctgtccagaatcagtaaagataaaaaatggctgctcgaaagtttgcaaaaacacggatacacaaacccttcagatatttctttttgctcgtttacagacggagaattatttattgatgaaaaagatgggcaccgcccgtaaccgttatcggacgattagacgtccgataatgggaatgcggcgaagctcatcttttttaattaaacggaaaacgagcaggaggattatataaatggcggcgctcaccgcaatccatccggctagattgacagcctcagatgctccaaagcttatatattgtttgatggcggagctgataaatccgcaaattacaataacagcgaagctgagcgcatactccttgattttgatgctgatcggcagcactttgcttacggttgctgcgtgcaatagcgtgacgagcaccatgcctgtcacaatggctaatgccgcgcccataatgccaagagaaggccttgtggcaaggacaaaaataaggcctgttttgacaagcgctccgattaagctgttcatcatcgcagctcctgccaaattaagcgcctgcagcacagcttgaagcgggccttggaaataataaagcagaaaaaacggggccatcacttttataaatacagctgcgcctgaggaaccgtacatcactctcatcagctcatccgcaaatacaaataaaataacaactgaaatgcctccgctgagcagacagagacgcatcgcctgttccaagcggtattccaccacctgcaattttttctgctccattccttcactgatcgcaggaacaagcgcggtcgacaaagaatatgtaataaagctgggcagagtcagcagcgtcatggcaaagccggtcagttccccgtattgctttgttgcggcaactgttgccacaccggcgatggcaaggctttgagcgacgacgattggctcgaaaaaccaagagaggtttccgataaagcggctcccggttgttggaagggacacgctcattaattgggtaaaggtttgttttccgtttttaattgactggaaaaaatgctttctgattctaattgtctttttatacttaaagcaaacgaataaataaagaagtgatgccagctcccctgccactgaggatagcattgcccccgctgcagcatattcaattccgtaagggagaaaaatcgttgtgcagacagccacgagtgaaatgcggacaacctgttcaaggacttgtgacatagcaagcgggttcatattctgttttccttgaaagtatcccctcagcacactcgatatagcaataatcggcacaaccggcgtaatggccaagagcggatacagtgttcgcttatctgtcagcatcgtttcagccataaccggggcgaaaaacagaaacagcggtgtaaagatgaggctgagcactcccgtgatggtcagagacatgactaaaatatttttcgttttttgatgatctccgcgcgcactggcttcagcgactagcttactgatcgcgaccggcagaccgaattgagttaatgtagtggccaagaagaaggtaggcgccgccatcatgtaaagcccgactccttcttcaccgataaaacgggcgataaccacccggttgacaaacccgagcattcttgtaaccattcctgctgcgataaggataagagtgccctttaaaaacgtctgtttcgccatttttaccccctgccttctcaaactacctggaatcatatacaataaagatatgcgtatatatcgtccaagcatgacaagtcttcttgaaaaacaataaaaaaggagcgtggaattcgtggagaagcatccagccgatctatataaagaccacgtcaggccgtttctttacagcaaactggaagagtttaagattctcgggtatgatgatgttgaactcgaaagtttgtggtcatacttaacagataagaagtggaaaaagaaaacggaactgaacatttatgaactggcgagtgatattttatcagtgaaaattggcgaatttatgaactatgcaaccgttgagtcatttaaaacgtctaattggctgggcagtgaagagggccaggaagcattggaagaactgctgagatagcaggttgattcgcacaggtttaagggaggatatacataatgaaaaaaggacgcttgattgcgtttttccttttcgttctattgatcggcacgggcttgggctactttacgaagcctgccgctaacaatattacgttaggattggatttgcaaggcggatttgaggtgctgtatgatgtacagcctgtaaaaaaaggtgacaaaatcacaaaagacgttctggtcagcacagtagaggcattgaaccgccgggccaatgttctcggtgtcagcgaaccgaacatccaaattgaagggaataaccggattcgcgttcagctcgctggtgtgacaaaccaaaacagagcgcgtgaaattttggcgactgaagcgcagctttctttcagagatgcaaatgataaggaactgttaaacggtgctgatctagtcgaaaacggcgctaaacaaacttatgatagcacaacaaatgagccaattgtcacgattaagctgaaagacgctgataaatttggtgaagtgaccaagaaggtcatgaaaatggcgccaaacaaccagcttgtcatttggttggattatgataaaggtgattcctttaagaaagaagttcaaaaagagcatcctaaatttgtatccgctccaaatgtaagtcaggaactaaatacaactgatgtaaaaattgaaggtcatttcacagctcaagaagcgaaagatttagccagcattttaaacgcaggcgcacttcctgtgaaactgactgaaaagtattcgacatcagtaggcgcgcaattcggccagcaggctctccatgatacggtgtttgccggtattgtcggtatcgcaattattttcttatttatgcttttctattaccgtctgccgggattaatcgcggtgattacgctgtctgtttatatctacattacactccagatctttgactggatgaatgccgtactcacgcttccgggaattgccgctctcattttaggtgtcgggatggctgttgacgccaacattattacctatgagcggattaaagaagagctcaagctaggaaagtcagtccgctctgccttccgttcaggaaacagacggtcatttgcgacgatttttgatgcgaatattacaaccattattgcagcggttgtgctctttatctttgggacaagctctgttaaagggtttgcgacaatgctgatcctatcgattttgacaagctttatcactgccgttttcttatcgagatttctcctcgctctccttgtggaaagcagatggcttgatcggaaaaaaggctggtttggtgtcaataagaaacatatcatggatattcaggatacggatgaaaatacagagccgcatacgccattccaaaaatgggatttcacgagcaaacgcaaatacttctttattttctccagtgcggtcacggttgccgggattattatcctgcttgtgttcaggctgaatcttggcattgactttgcaagcggtgcacggattgaagtgcaaagcgaccataagctgacgacagagcaagttgagaaggactttgaatctctgggtatggaccctgatactgtagttctgtcaggcgaaaagagcaatatcggtgttgcccgttttgtcggggtgccagataaagaaaccatagcaaaagtaaaaacgtattttaaagacaaatacggatcagagccaaatgtcagcacagtttcaccgacagtcggtaaggagctggcaagaaatgcgctgtacgcagttgctatagcttctattggcatcattatttacgtttcaatccgattcgaatacaaaatggcgattgctgccattgcttcattgctatatgacgcattctttatcgtcacgttcttcagtattacaaggcttgaggtagatgttacgttcatcgcggccatcttgacgataatcgggtattccattaacgatacaatcgttacatttgacagggtccgcgagcatatgaaaaagcgtaagccgaaaacatttgccgatctgaaccatatagtaaacctgagcctgcagcaaacctttacacgttcaattaacactgtattaactgttgtgattgttgttgtgacattgctgatctttggagcatcttctattactaacttctcaattgctttattggtcgggctgttaacaggcgtttattcttctctatacattgccgcacaaatttggcttgcatggaaaggaagagaactgaaaaaagattcggcgcaataaaaaatatcaggctgtcctctgcagggcagcctgttttttgaagtttcattgaacttaaaatagacatttgctataatgacatacgcttacatttaaacatatatatggtgttaaaagtgtttatgactggttttcagatatgtaggagggtttatatatgagggttcgcgaatcagagctaccgggcataggacaaaaagttgaaatgattactagaaaccgtgataaaatttcaattatcattcatcatgacggacggagagagctttactattttgaccaaaacgaccatgaggaatgtgttgcctccgtgcagtttgatgacgctgaagcaaggcaaatgtctgcaattcttggcggaatggcatataaaccgaaagcattagaacaggtcgagtcagcccttgatgatttgattatagagtggtgtaaagcagaggcgggagcgcctgccattcatcagacgattggtgatttgaatgtgggtcaggaatatcatgtgacggtcattgcaattgttaaaaagaatcaggataaacaactgaatccgagctctgaaacagtcattgacgaaggcgatacacttgtgatttccggtgagggaaccggactgaagaggctgatccgggaaaaattaacagcgaagggatcttaacccagtgttaagccatgtttaaaaccagtcttgatggggaaagttacctcaataagaagtttgggggaaaagagaatgaataaacaatggaccattattttcgcacttattttcaccttaattgtcgctattttcgcagtcattaatgttcgatccgtagaagttgattacctgtttggaagatcagaatggccgctcattcttgttattttgggctcagttttaatgggagcgctgatcgtattttctgtcggcatttttcaggtaatgaaattgaagcgggaaataaaaaccttgcggaaagaaaatagaacagcaatacataaacaagaggatactcatcttgctgatcagactgacacacaggatgcatcagccatgattgagaaaaaagactagttttcgaatattatttgaaacccctcagcctgctctagtataatagggtggttgaggggtgaatttatgttagcgtcaaaaatgcgatgggaaatccagcgaccagatcaggataaggtcaaatcactcacagaacaattgcatataacacctcttgttgcgtccctgcttgtaaaaagaggctttgatacggcagaaagcgctaggctgtttttacatacaaaggatgccgatttttatgatccttttgaaatgaaaggcatgaaagaagcggcagatcgaataaaacaggcgatttcacaacaagaaaagattatgatatatggcgattatgacgccgatggggttacaagtacgtcagtgatgcttcacacgctgcaaaaactgtcggctcaagttgatttttatatacctgaccgttttaaagaaggatatggacctaatgaacaggcgtttcgttcgattaaagaacggggcttctctttgatcattacggttgatacaggaattgccgctgtgcatgaagcgaaggtggcaaaggaactcggactggatgtcatcattaccgatcatcatgaaccgggaccggagcttccggatgtccgtgcgatcgtccacccgaagcagcctggctgcacttacccgtttaaagagcttgccggggttggagtcgcgtttaagcttgcccacgctttattgggtgaacttcctgatgaactgcttgacctggcggctatcggcaccattgccgatctagtcccgctgcatgacgaaaacagattaatagcaacactaggacttgaaaggcttcgacggacaaatcggctcggcttaaaagagctgattaagctgtcaggcggagacatcggagaagcgaacgaagaaacagtcggatttcagctcgcaccaaggctgaatgccgtcggaagaatcgaacaggcggatcccgctgttcatttgcttatgtcagaggattcgtttgaagcggaagagcttgccgcagaaattgaccagctgaacaaagagcgccaaaaaatggtcagcaaaatgacggatgaagcgattgaaatggttgaacagcaagggctcgatcaaactgcaattgtcgtggccaaagccggatggaacccgggagtcgtcgggattgtggcttcaaagcttgtggaccgtttctaccgaccggccattgttcttggcattgatgaagaaaagggaatcgctaaaggttcggcccgaagcatcagaggatttaatttatttgagagcctttctgaatgcagagatattcttcctcatttcggcggccatccaatggctgcggggatgacgctgaaagccgaagatgtgccggatttgcgaagcaggctgaatgaaatagcggacaatacgcttacggaagaggattttattcccgtacaggaagtcgaccttgtctgcggcgtcgaagacattacagttgaaagcatcgcagaaatgaacatgctgtctccttttggcatgctgaacccgaaaccgcacgttctcgtagaaaacgcagtactggaagatgtccgcaagataggggcaaataaaactcatgtcaaaatgacgatcagaaacgagtcgtcccagcttgattgcgtcggttttaataaaggcgagcttgaagaaggcatcgtaccgggttcaagaatttctattgtcggtgagatgtcaatcaacgaatggaacaatcgaaaaaagccgcagcttatgataaaggatgccgctgtttctgaatggcagctgtttgatttaaggggaaaacggacgtgggaagacacagtttccgtccttccatctgctaaacgggccattgtctctttcaaagaagactcaacaacattacttcaaactgaagaccttcgccgagaagtgcacgtcatcagttctaaagatcaagcaaaggcgtttgacctcgatggtgcatatattgtattactggatccgccgccttcgctggacatgctcgcacgtttgctggaaggcaaggcgcccgagcggatatattttatttttctcaatcatgaggaccactttttatcaacttttcccgcaagagaccactttaaatggtattatgcgttcttgctgaaaagaggcgcttttgacgtgaaaaaacacggttcagagcttgcaaaacataaaggctggtccgttgaaacaatcaatttcatgacaaaggtgttttttgatctcggttttgttaaaatagagaatggtgtgctgtctgttgtgagcggagcaaagaaacgcgacttaacagactcacaaacatatcaggcgaaacagcagctgatggaactggatcaaaagctgaattattcttctgctgaagagctgaaggaatggctgaataagctgatgaaacaagattcagaggcttatgaaagtacgaggaggacataaaacagatggatttaaaacaatacgtaacaattgtaccggattacccgaaagagggcgtgcaatttaaagatattacgacactgatggataaaggcgatgtataccgctatgccacagatcaaattgttgaatatgcgaaagaaaagcaaattgatttggtcgttggccctgaagcgcgcggctttattatcggctgtcccgttgcttacgcgcttggcgtaggttttgcgccggtccgcaaagaaggcaagttgcctcgtgaagtaatcaaagtggattatggcttggaatacggaaaagacgtattaacgatccacaaagatgcgattaagcctggtcagcgtgtgcttattacagatgacctgcttgcgacaggcggcacaattgaagcgacaatcaaacttgttgaagaacttggcggcgttgttgctggtatcgctttcttaatcgagctttcttaccttgacggcagaaataagctcgaagattacgacatcttaacattgatgaaatactaaggataaccgcataacgaaaaagcactccatgtcagggtgcttttttcctattgttttgcatttattttatataatatttggctatttgaacttctgctctttacatctttcgtttttttcttgataataaactacaatacagtttacattttaaaaaaggtgattccatggcgaacgaacaagtattgactgccgagcaagttatagataaagcgcgcagctatctatctgatgagcatatcgcatttgtcgaaaaagcatatctgtacgctgaagatgctcatcgcgagcaataccgcaaatcgggcgagccatatattattcatccgattcaggttgcggggatactcgttgatcttgaaatggacccttccacaatcgcgggcggatttttgcacgatgtcgtggaagatacagatgtgacgctcgatgacctgaaagaagcattttccgaagaagtggcaatgcttgtagacggcgtaacgaaactcggcaaaattaaatataaatctcaagaggaacagcaggcggaaaatcatcgcaaaatgtttgtcgctatggctcaagatatcagggtcatattgatcaagctggcggatcgtcttcacaatatgcggacactgaaacatctgcctcaggaaaaacagcggagaatctccaatgaaacgctggaaatttttgctcctttggcgcatcgtctcgggatttcaaaaattaagtgggaattggaagatacggcgctccgttatttgaaccctcagcaatattacagaattgtcaacctcatgaagaagaaacgtgcagaacgtgagctttatgtcgatgaggttgtcaatgaagtaaagaaacgtgtcgaagaagtaaatatcaaggctgacttctcgggacgtccgaaacatatttacagcatttatcgaaaaatggtgctgcaaaataagcaattcaatgaaatttacgatttgctggctgtccgtattcttgtgaatagcataaaggactgctacgcggtgcttggcatcattcacacatgctggaaaccgatgcccggcagattcaaagattatatcgcaatgccgaagccgaatatgtatcaatcgcttcatacaacggttattgggcctaaaggcgatccgcttgaagtgcagatccgcacctttgaaatgcatgaaatagcggaatacggggttgcggctcactgggcttataaagaagggaaagcagccaatgaaggtgcaacctttgagaaaaagctttcttggttccgtgaaattttagaatttcaaaatgaatcgacagatgcagaagaatttatggaatcgctcaaaattgatttgttctctgacatggtgtatgtctttacgccaaaaggagatgtaatcgagcttccgtccggttctgttcccattgacttttcttaccggattcactctgaaatcggcaataaaacaatcggtgccaaagtaaacggaaaaatggttacgcttgaccataagcttcggacaggtgatatcgttgaaattctcacttctaagcattcctacggcccgagccaggattgggtgaagcttgcccaaacatcccaagcgaagcataaaatccgtcaattctttaagaaacagcggcgtgaagaaaatgtcgaaaaaggccgtgagctggtcgaaaaagaaattaaaaacctggattttgaattgaaggatgttttaacgccggagaatattcaaaaggttgctgacaaatttaatttctcaaatgaagaggatatgtacgcggcggtcggttacaacggcattacggctctgcaggtggcgaaccgcctaacagaaaaagagagaaagcagcgcgaccaggaagaacaggaaaagatcgttcaggaagttactggggaacctaagccgtacccgcaaggaagaaaacgggaagctggcgttcgtgtcaagggcatcgacaacctccttgtccgtttatcaaaatgctgcaatcctgtgccaggtgatgatattgtcggctttatcacaaaaggcagaggggtttcggtccatcgcgaagactgtccgaatgtcaaaacgaatgaagcccaagagcggctgatcccggtagagtgggagcatgagtcacaagttcaaaagcgcaaggaatacaatgttgagatagagattcttgggtatgaccgccgcggattgctgaacgaggtgctccaggcagtgaatgaaacgaaaacaaatatttcatctgtctctggcaaatcggatcgcaataaagtggcaaccattcatatggcgattttcatacagaatatcaatcacttgcacaaagtcgtcgagcgtattaaacagattagagatatctattctgtgcgccgcgtcatgaactaaaggggttagaaaatgagattagttgttcagcgagtaacagaagcaagcgttacagtggacgaagaggtcgtcggccaaattggacaaggccttatggtgctggtcggcatcactcacgatgatacagaagatgatgcagcttatttagccgataaagttgtcaatctccgtattttcgatgacagtgaagggaaaatgaatctgtctcttgtagatataggaggagagattttatccgtctcacagtttacgctttatggagatacgaaaaaagggcgccggccgaactacatgaacgcggccaaacctgataaagctttaggtctttatgaaaaatggaatgacctgcttcgtgaaaaaggaatcaaagtggagaccggaacgtttggagcaatgatggatgttcagcttacaaactccggaccggtcacgctcattatggattcaaaataaaaaaagctgccaaaaggcagctttttttattggaagtatttctctaatccgctttcgatcccatctgttactttttcttggtatgaattgctatgtacaatggcttcttcctgcggatggcttacatatcccagctcgtacagcatagcgggctgtctgttttcccggagcacataataatctccgaataatacgccgcggtctggaatggaagaacgcttcaccacttctgagtggacatctgatgcgagttcctgatctttggcaggactgtagtaatatgctgtactgcctcttgtagaggtatccgcatagctgtcataatgaatgctgataaaggcgtcagcgttacggtagtgagaggtagagacccgtgactgcaggctgacaaaggtatcatcctggcgtgtcacatatacatccgctccagccgatctaagtttgctggcgagcagttttgccgttttgatcgtcaggtttttctcgaatttccccgaatacccgatcgttccgctgtcttttcctccatgtcccgggtcaacaataatcgttttattgtttagagagccgtttccagacggggaatcagagactggcggttcacctgcttcttctgcgcttttagacgtttggaccacccaattggctacataagcagtctgcccgttatcaagctttatttcataccagcttccctttgaaccggtaatggtgtatgaatctcctttggcagcgcgctcaacgatcgaagctgatgttgacgcatcacttcttagattcgttcctccgtacatgatataggcttttttagcggaggatgaactgccggcatttgctgaatcatcagctggaacagaactagtcaaaaggtaatggcttgcaacccagccttttagcccgttcacctcaatgtgagcccagccatttttctcgttgagaaccgtcagtttcgttccgcgatcaagttttgttataattgccgcgtcatgtgaggcggaggctcttacatttagcgaagaaacaccgactgtgcccgtcgttgactcaccggaatcctcggtttggtcactctcatcagacgctgaactgctgcctcctgatgtgacatattcagatgatacccatccggtggcactgtgataggatatcttgatccagcccgaatctttatcaatgacagatgcttggctgccttgcgggaatttgccgatgacttcgtaggaagtgcccgggccgcttctcatccgcagatcggggtctgttgatgtcacagtgtcactgcttcctgaggagcttgtgctggcctggtcttcctttgtaataagccaggagactacccagcccttttctccggaaccaagctgtatctgcacccagtctccatcttcctttaaaatcggataacgttctcccttttttacttccgctgtaatgccgtagctaagcccagggccgcttctgacgttcatttcatctgttgcgatgaccgcttctccttgagcagctgtaacggatgaaaaggtcgggaatagcgctgaggtgaaaataatacatacaataaggacaaagtatttcttgttcattgtgtcctcctttctgatgatcattaaaaaagcattcttgtttaatatcgtaaagtcctttctgatttttaaataaaaataaaatgatttgtttatactaagcgtaaatacaatcaaaaaggtgtgcaaatcatgaaatatcatccaaaaatgggacgtgcatttcacgacggtgaagcgaatctgcattacagcgatcacgcagatcccgatacgactggttatcttacggaaacagcatctgaatttggtcttatgtccaaagaagcagcgctgaggaaaaacaaccggaataaagcttgacagagaaccccaatcccattattataatagaaattgagtacatagcaaatgatgaaagatttgaaccaataatggagaagagtaggtcagattgcatgattagagaggaacccgccccaggctgaaagcggatcccattgcgtctttctcgaaacaacactccggaggtttcctgctgaacgcgttaataacgccattaggcagtgaacgtgaacctgcgttaaaggatcgagcgggaatatgaacgtattccaactagggtggcaccacgggtataactctcgtccctactatcatgtatagtaggggcgggagtttttttcattttcatcattaacgatcattggatattttataaggaatacataaggaggtctacctatgggatataacattccgagaggaacacaggatattctgcctggagaatcagatcgctggcagtatgttgaacaaattatgagagacacttgccgcacttatcaatataaagaaatccgcacaccgatttttgagcatacagaactgtttgccagaggcgtcggagaatcaacggatatcgtacaaaaagaaatgtataccttcgaggatcgcaaaggcagaagcctgacgcttcgtccggagggaacagctgctgcggttcgcgcctttaatgaaaacaagctgttcgcaaatcctgtacagccgacaaagctttattatgtcgggccgatgttccgttatgaacgtcctcagacgggccgttaccgccagttttatcagtttggaattgaagcgattggttcgaaagaccctgcaatcgacgctgaagtaatggcgcttgcgatgagtatttatgaaaaagcaggtttagaaaacgttaagctagtcataaacagtctcggcgatcaagatagccgcaaaagctacagagaagcgctcgtgaaacacttcgagcctcgcatcgaagaattttgttcagactgccagtcacgactgcacacgaacccgcttagaatcttggactgcaaaaaagaccgagatcatgagctgatgaaatcagcgccttcgattttgacatatttaaatgaagaatcagccgcttattttgacaaagtgaaacaatacttaaatgatcttggcatttcgtatgaaatcgatccgaaccttgtgagagggctggattattacaaccacaccgcatttgaaattatgagcaatgcggagggctttggcgcgattacgacacttgccggcggcggacgctacgacgggcttgtcgaacagatcggcggacctgaagcaccgggcatcggatttgcgatgagcatcgaacgcttgcttgccgcaattgatgctgaaaaaagagagctgcctgttgataagggaatcgactgctatatcgtcacactcggcgaaaaagcaaaggattattctgtttcattggtgtacaaactgagagaagcaggcatttccagtgaaatcgattatgaaaataagaaaatgaaaggccagtttaaaacagctgatcgcttaaatgccagatttattgcgattttgggtgaagatgagcttgcccaaaacaaaatcaatgtaaaggatgcacagactggcgaacagattgaagtggcacttgatgaatttatacatgtgatgaaggcaaactaaaagggataaggagtgaaacgcattgtttggaagaacatattattgcggtgatataactgaaaaagcaattggcgaatctgtaacgctgaaaggctgggtccaaaaaagacgagacctcggcggattgatttttattgacttgcgtgaccgtacgggcattgttcaagtcgtttttaaccctgatgtgtcaaaagaagcgcttgctattgcggaaggcatcagaaatgaatacgtgcttgatattcaaggaaaagtggtggcgcgtgaagagggaacagttaatccgaatttgaaaacaggcgcgatcgaaatacatgctgatggagtgaacgtattaaatgctgcaaagacacctccatttgcgatttctgatcaagctgaagaagtgtcagaggacgttcgtttaaaacaccgttacttagatttgcgcagaccggctatgttccagacgatgcagctgcgccataacgtgacgaaagctgttcgcagctttttagatgaaaatgggtttcttgatattgaaacgccgattttaacaggaagcacgcctgaaggcgcacgtgactacttggtgccgagccgtgtgcacgaaggtgagttctacgcgctgccgcagtccccgcagctatttaaacagcttctgatggtatcaggcattgaacgatattatcaaattgcccgctgtttccgcgatgaagacttgcgtgcggaccgtcagcctgagtttacgcaaattgatattgaaatgtcctttatgagccaggaagacgttatgtcattggctgaggagatgatggcaaaggttatgcgtgaaacaaaaggtgaggaacttcagcttcctcttcctcgaatgacgtatgacgaagcaatgaacaagtacgggtctgataaaccggatacgcgttttgacatgcttttgacggatgtgtctgacattgtaaaggatacggaatttaaagtgttctcatcagctgtagcaaacggcggcgtggtcaaagccatcaatgtaaaaggcggtgccggcgattactccagaaaagacatcgacgctcttggcgcttttgctgcaaactacggggcaaaagggcttgcctgggtgaaggttgaggcagacggagtgaaaggcccgatcgctaaattctttgatgaagaaaagcagtctaagctgattgaagcacttgatgctgctgaaggtgatttgctgctgttcggagcggatcaattcgaagttgtggccgcatcactcggcgccctgcgcttaaagcttgggaaagagcgcgggctgattgacgaaaaattgttcaatttcttatgggtcatcgactggccgctattagagcatgatccggaagaaggccgtttttacgcagcgcaccatccgttcacaatgcctgtccgagaagaccttgagctgattgaaacagcgcctgaagacatgaaagcgcaagcttatgacctcgtcttaaacggctatgagcttggcggcggttcaatccgtatttttgaaaaggatattcaggaaaaaatgtttgcgcttctcggcttctcaccagaagaagcggctgaacagttcggattcctgctggaagcatttgaatacggcgctcctccgcacggcggaatcgcactcggcttagaccgtctcgttatgcttctcgctggacgtacgaacctgagagatacgattgcattcccgaaaacggcaagtgcaagctgcctgatgacagaagcgccaggcgaagtaagcgacgcccagcttgacgagcttcatctttctatcaagaaaaaagttaagaactgaatttgcagttcgattcttgaaaatcaaaatcgtctgtgatatgattttgacaagttaaataaagtcctgatgtgttagttgtacacctagttttgaccgaacatttttttgatttgggagcccgcatttttaaatggcgtacatgcctcttttcattcggtaaagaggacttacaagatttaaaagagggcacccacctgctgagagcgggttcaaaacaaaggaaagctgcaacggcactattgggactttattttttgtgcgcagaaaaaacggctgctcatggatcagccattttatagatgaaaccagaatacgaatgtggagtgaggttcttgttacaccagttttcacgcaatgaattagctatcggaaaagaaggccttgaaacgctgaaaaacagcacagttgctgtgcttggagttgggggagtcggatcgttcgcggcggaagctctcgcgcggtcaggcgtcggccgcattctgcttgtcgacaaagatgatgtcgacattacaaatgtaaaccgtcagcttcacgcgctgctttcaactgtcggacagccgaaagttgatttaatgaaggcgcggatcgcagacattaacccgaagtgcgaagtgatcgcgttaaaaatgttctatacggaagaaacgtatgagcaattttttgactatgatcttgactatgtcattgatgcgtcagacaccatttgttataaaatacatttaatgaaagaatgtctaaaacgggatattccgctcatctccagcatgggtgctgcaaataaaacggatccgacacgcttccaaatcgctgatatctcaaaaacgcacactgatccaattgcgaaggtcgtccgtacgaaattacgcaaagagggtatcaaaaaaggcgtccaagtgattttctctgatgaaagcccgattgtcattcgggaagatgtcagaaaagaagtgggaaatgacgaagcgaaaatccgtaaagcaaaaatgccgccttcctctaatgcttttgtgccgtcagttgcaggtttgattatgggcggccatgttgtcatggatcttttgaaagacattgagatcaaacgtgtgaaggataaataatgcataaaaacagccttgatgatcaaggctgtttttgttttattttcttttcattaatttatcgtacacctgctttaaggcagattcgaactttccagtctgtttcggcttatagtattgcttatttttcagaggatcagggaggtattgttgttcgacccaaccgttgtcgtaattgtgcgggtatttatagtcgattcctcttcctaattcctgagctcctttataatgcgcgtcttttaaatgcttcgggacatccccaatttttccggctctgatatctgccagggcctcatcgattgccagaatggcagagtttgatttcggtgagaggcaaagctcaataactgcgttggccagcgggattcgcgcttcaggaaacccgactcgctcagcggtctgaatagcgttcagcactctagggccggcttgcgggcttgctaaaccgatatcctcataggcgataacaagcaatcgtcttgcgatgctctccagatcaccggcttcaattaatctagccaaatagtgaagagcagcgttggcatcagagccgcggattgatttttgaaaagcggacagtacatcataatgcgcgtcaccatctttatcgtgagaaaagctttttttctgcaagcattcttccgcggtttctaatgtaatgtgaatttcaccgtctgctgactccttcgttgacaacacggcaagctcaagcgcatttaaagcggagcggacatctcctccgcatccgtgggcaaaatgctccatcgcctgatcatcaatggatacagaataggtgccaaggccccgatgctcatcatggagcgcacgttccagtgcctgtttaatcagttcaggtgttaacggttcaagctcaaaaatctgggtccggcttctgatcgccggattaatggcatgatacgggttagccgtcgttgctccgatcaaaatgatcattccgttttctaaatagggtaatagaaaatcctgttttcctttatccagcctgtggacttcatccagaatcaaaatcacttggccggacatcttggcttcctgagctacgatttccatatcttttttattgttaatgacagcattcagctttcgaaaagcaatacttgttgaaccggcgattgctgttgcgattgatgtttttccaattccgggcggcccgtacaaaatcatggatgacaaatgttttgcctggaccattctgccaataattttatcttcagccaccagatgctgctggccgataatatcctctatttttgtcggacgcatccgatatgccaatggcttcatctatcatctctccttacttaattacagggtaacggaaaaccgtacattagaaaagggtaaaggcccctttccttctgcctcaatgaaaattcgctgaaggtatgttataataacagttggtctataagataataaacggacgaaacatatagaaattaccattataaatgtggaaaatcatgaaataacagaggtgttcatgttgaaaatatcaactaagggaagatacgggctcaccattatgatcgagcttgcaaaaaagcacggtgaaggcccgacttcattaaaaagcatcgcacagacgaataatttgtccgagcattatttggagcagctggtatcgccgctcagaaatgccggtttagtgaaaagcatcagaggcgcatatggcggatatgtattaggcagtgagccggatgccattaccgcgggagatattatccgtgtgcttgaggggccgatcagccctgttgaagtgctggaagatgaggagcctgccaagcgtgagctctggattcgcatccgggatgctgtaaaagaggttttagacagtacaacattagaggatcttgccagctatacagacggagagcaagaagcttatatgttctatatttagatcagaggtgtaaacataatggaacggatttatttagatcatgccgcaacgtctccgatggatgagcgcgtgctggaaaaaatgataccgcacttctccggcagtttcggtaatccctccagtattcattcatttggcagagaatctcgaaaatgggtggatgaagcaagagcgcagatcgcagcagaaatcggagcggcagagcaggagatcatttttacaagcgggggaacggaagctgataacttggcgatcatgggaaccgcacttgcaagaaaagatcttggcagacatatcatcacaacaaaaattgagcatcacgccgtgcttcacacatgtgaaaaacttgaggaagacggatttgacataacgtatctggacgttgaccaaaatggaagagtcagtgcaaaacaggtgaaagaagcactgcgtgatgatacaatccttgtgacagtgatgtatggaaataatgaagttggaacagtgcagccgatcgaagaaatcggtgagctgttaaaggaacacaaagcttattttcataccgatgctgttcaggcattcgggttgctgccaattgacgtgaaaaacagccatattgaccttctgtctgtttccgggcacaagctcaacgggccaaaagggacaggctttttatatgctagtaaagatgtgaagctttcaccccttttattcggaggagagcaagaaagaaaacgccgtgccggaacggaaaatgttccaggcattgtcgggctgaaagaagcgatcaagctgtcaagtgaagaacgtgacgaaaaaaacgagaagtatcaatcgtttaaagcaatctttgccgacacgcttagagatgcaggtgtggcattcgaggtcaacggggacaaagagcatagtctgccgcatgttctgaatctttatttccccggtgtgtcagtggaagcgctgctggttaatcttgatatggctggtgtcgctgtctccagcggttcagcgtgcacggccggttcagtcctgccgtcacatgttctgactgctatgttcggcgaagagagtgaccggctgacgtcctctattcgaatcagcttcggcctcggcaatacggctgagcaagtgaaaactgctgccaaacatgtggccgacgttgtcaaacggctgacataataaggcggcgtagtaattggagtgaatgaaatggaaaaacggccggaggatacaagagtcgtcgtcggcatgtccggcggagtagactcatctgtggcggccctgctgttaaaagaacagggctatgatgtaatcggaatctttatgaaaaactgggatgatacggacgaaaacggtttttgcacggcgacagaggattatgaagatgtgatccgcgtctgcaaccaaatcggaattccgtattatgccgtaaactttgaaaagcaatattatgagaaggtatttcaatacttccttgatgaatataaagcaggcagaacaccaaacccggatgtattgtgcaacaaagaaattaaattcaaggcctttttggagcatgcattgtcacttggcgccgactatttagcgactggccactatgcaagagtagacagaagcggcggaaaagtcagaatgctgcgcggcattgatgaaaacaaggatcaaacgtacttcctgaatcagctgacagaagatacgctgagcaaagtcatgttcccgatcggcgaacttcaaaaaagccgtgtgcgtgaaattgccaaagaagcagaacttgcaacagcgacgaaaaaagacagtacaggcatctgctttatcggcgaacgcaacttcaaaacgtttctcagccaatatctccctgcacagccgggcgatatgatgacgatggacggcgaagtaaaaggccgccacgacgggttgatgtactatacgatcggacagcgtcacggccttggcatcggcggaagcggcgagccgtggtttgcggtaggcaaagatcttgaaaagaacatcctctacgtagatcaagggttccataacccgcttttatattccgacaaaatcacagcaacaaatatcagctgggtacgttcggatatcatgaagggcgaagagatttcctgcacggctaaattccgttaccgccaagaggatcataaagtaacagtgcgcatgactggcgaaggtgaagcggaagtcatctttgatgaacaagtccgcgctgtaacgccgggacaagccgttgtcttctatgacggcgaagaatgccttggcggcgggacaattgatgatgtgtacaaagacggaacaaaattgtggtacgtataaaagatgaaaaacctcaacactgagttggggttttttaatgaaaggaagatgatcggtggattataatcaactcggtatagaggcgatgcaggaaggcgattacgagaaagcggcagaggcatttacaaaagcgattgaagaaaataaagaagacgcgattccgtatatcaattttgccaacctgctttcatccgtaaacgagctggaacgtgcgcttgcgttttatgataaagcgcttgaattagacaatagcgcagccactgcttattatggagcaggaaatgtctatgttgtaaaagaaatgtacaaagaagccaaagacatgtttgaaaaagcgcttcgtgcggggatggaaaacggcgacctgttttacatgctcggaacggtgcttgtcaagctcgaacagcctaagcttgcactgccatatttacaaagagcagtcgaactgaatgaaaacgatacggaagcgcgttttcaattcgggatgtgcttagccaacgagggcatgctggacgaagcgctcagccaattctcagctgtgacagagcaagacccggggcatgctgatgcattttataatgccggtgtcgcttatgcttataaagaaaaccgagaaaaagcgctggaaatgctggacaaggcaatcgatatccagccagatcatatgcttgcgcttcatgctaaaaaactgattgatccatcataacaggcacaggaggagggacagctcgtgcagcagcatccggatcagcttaaactggaggaagagccctatttaaaagggacagtcaacacagtcatctatcataatgacaccaatttatatacggttctgaaagtgaaagtcacagagacctccgaagccattgaagataaagccgtatccgtgacgggctacttccctgcgcttcaagaagaagagacctacacgttttacggaaagatcgtaacccatccaaaattcgggctccaatttcatgcggagcatttcaaaaaggagattccaacgactaaggaaggcatcattcaatatttatcgagtgatttattcgagggaatcggcaaaaaaactgctgaagaaattgtgaaaaagctgggcgacagcgccattaataaaatattggctgacgcttcagtgctttatgatgttccaagactctcaaaaaagaaagcagacacgctggctggcgcattgcagcggcatcagggactggagcaaatcatgatttccttgaatcagtttggctttggcccgcagctgtctatgaaaatctatcaagcctatgaatccgagacgcttgaaaaaattcaggaaaatccttatcagcttgtgaaggatgtagaaggcatcgggtttggaaaagcggatgagctgggcagcagaatgggtctttcgggtaaccatcctgagcgggtaaaagctgctattttgtacacgcttgaaacgacttgtttgtcagaggggcacacgtacatagaaacggaacagctgatcattgacacccaatctctgttaaatcagtcagcaagggaaggacagcgcatcacagaaatggatgccgctaacgcgattattgcccttggagaaaataaagacattgtcattgaagatggccgctgttattttccgtcgctgttttacgcagaacaaaacgttgcaaagcgtgtgaaacatatcgctagccaaaccgaatatgagaaccagtttcccgaatcagagtttttgctcgcgttgggagaactggaagaacggatgaacgttcagtatgcccccagccagaaggaagcgattcaaaaagccctttcctcgccgatgcttcttttaacaggcggcccgggaacaggaaaaacgacggtaatcagagggattgtcgagctctacggagagcttcacggtgtgtcactagacccgtcagcttataaaaaggatgaagcttttccgattgttttggccgctccgacagggagagcagcaaaacggatgagtgaatcaacgggacttcctgcagtcacgatacacaggctgcttggctggaacggtgctgaaggctttactcatacagaggatcagccgatcgaagggaagctgttaattatcgatgaagccagtatgcttgatatatggctggcgaatcatttgttcaaggcgatccctgatcatatacaaatcatcattgtcggagacgaagaccagctgccttccgtcggtccgggacaagtgctcagagacctgctggcatcccaggtgattccgactgtgagactgacagacatctatcgtcaggcggaggggtcatcaatcgtcgagcttgcccaccagatgaaaaatggattgctgccgaacaatttgactgccccgacaaaggaccgttcctttattcgctgcggcgggtcgcaaatcaaagaagtagttgagaaggttgtcgccaatgcattgaaaaaaggctatacagcaaaggacattcaggtcctcgctccgatgtacagaggaaaagccggcattaatgaattgaatgtgatgctgcaggacattttaaatcctcctaaagaaaaacggagagaattgaagttcggggatgttgtctacagaaccggagataaaattttgcagcttgtcaatcagccggaaaacaatgtgttcaacggagatattggcgaaatcacgtcgatattttatgcaaaggaaaatacagaaaaagaagacatggccgtcgtttcttttgacggcaatgaaatgacatttacgaaaaaagattttaatcaatttacccatgcgtattgctgttctattcataaatcgcagggaagtgaatttccgattgtggttttgcctgttgtgaaaggctattatagaatgctcagaagaaaccttctttataccgcgattacaagagcgaagaaatttctcattttatgcggggaagaggaggcgctggagtggggcgtgaaaaataatgatgcaactgtcagacagacctccttgaaaaacaggctgtccgtacaggttgaggaaatggatgccgagcttgaagctttgcaaaaagagctcccgttcagcgtacacgacgccaacattggcatggaaggcattacaccattcgattttatgaaagaagaacagcaataaaatgctcccgtgcaagcgggagtttttttcatttgcagtggaattgatttcatcgtatgagtctaaggcgcaaagcaaaacctaagcctgttcaacaaaaggtggttgatcacactttgagaacatgccatgaagtagaaggattcccagtatactcagaacgaacttcttgttatctcggggcaatttccgatatttgtttttctctgaaaggagattgtcttgggtttattcttgcacaaaaacgctttttgcatcatcatcatgcgctattacgggcgtgtgatatctcttccattcttgatgaccgcatattggcttcggtcagttcagaacagcttttgcctcttccgaaatcatgcttcacatacgagcagatgaagatgaagcttgtgaaatcgcaagagggcgatatattggggatgctggaagatgtatacttttgtttggacaggggcataatcgtagcatatgaactctcggacggtttcttttctgacctggcgggaagcaagcgccagatccaaagagcggattcgcttgtcgaggtgcggaaagacgagatcgttctgaacggatagaggtgtgaggtatgcttatatgcccgaattgcaaaagtaaggatatcggcaaaatcggcgtgaaccaatattattgctggggctgttttattgaactgacagtggcgaaagggaagattgcaactcatcaggtggaagaagacggaacgttaagcagcttggatgatttgttttctgaggatgaacgcagcatcaatttttaatcatgaaaggagatgcgcaggatgaatcggacgatgacttctcttttggcaatgggagccggagctctcgtgtaccgaatggcgactcaatctgacatgctgaataatcgaagcatgaagcagatgagaagaagaattacgaaaatgttttaatgtaaaaaggatactctccaaagagtatccttttctatgtttgccggacctcgaggcgtcttgctgcgagtgaaaggctgtagttgactgcgaaatacataagggccgcaagtaaaaagatcgggaaaaaataactgccgtctgcgctttggccgttaataatttgcgcgttgtgaatcagttcaggcagggcgatcacaacagcgagcgatgtatcttttaataaagaaataaactggcttacgatgggcggaaccatgcggcgaagcgcttgcggcataacgataaagagcagggtctgtgtatagctcagcccggaggagcgcgccgcttcaatttgtcctttgtcaattgatttcagtccgcttcggataatttcagatagcatagcggattcaaaaatcgttagtgctgtaattgcagcagctgtaatttcaagcttaatcccaatttccggaagggcaaaaaacgtaaagaaaataattaacagcaaggggaggtttctgatcgtttcaacgagaactgcaatcaattgagaaagaacgggaactttcgcataacgcagggtgcctgcgattaaaccgaagaaaaagctcagaatgatggagatgaaagcaacgtacaaggtgacgagaaagccatcccataaaaacgctaaatgctcctgtgaataagcaccgatgaaatccaatgtaactcactccttatcaatagcttttttccagccgtttttccagatagttaacaccgatgctaagcggaatcgtcagcactaagtaaaaaagcgccacaaaaatataaacatcaaatacaacgagtgtgctcgacgaaactaaatcggcttggtacataagatccaatccggccacaaccccaagaatcgaagagtttttgactaagtttaaaaattgattgcctaaaggcggaatgacgattttgattgcctgcggcaaaatgatatggagcatggcttggctgtaggtaaagcctgacgagcgtgccgcttccatctgcccttttgaaacagactggatgcctgctctgatggcttcagcgataaacgcagaggtataaatggtgagagcaaccgttcccgcttgaaaaccgtcaagcctcaggcctgcgtttggaagtccgaaatagaaaacaaaggtaattaaaagaagagggatgttgcggatgaattctacatatgcggtcccgagccattgcagcggcttaaagactgttattctcataaccgctacagcaacgccgaggacaaaactgccggccagcgcgataacacttgcgagcaaggtatggtaaaaaccgtccatatacatgctgaagttatcgaaaagaattgacacattcatctgcctattcactccttatcaaattgggatgagcatcgcctgctcatcccgggatggttgttattcagctgggtcttctttgatccattttttataaatttcatcgtatctgccatccgacttcatctttttaagtgaagcgttgatttctttcgcgagagcagattgcccttttttcacggcgatcccgtaaggctcatctgtaaaaggctttcctgttaattgataatttttattttcatcagccattccatataaaatcgcattatctgtggtgagggcatcgccttgccccgatttaagggctgtaaaggcttctgcgtagttttcaaattctaaaacagatgcttcaggcgccttttcacgaatgttttgagaggaggtggagccttttactgcaagaacttttgagcctttgccaagattctcgacactcttgattttgctgccttttttcacgagaagcgattgcccggcctcgaaatagacatcagaaaagtcaacttccttttttcgttcttcagtgatcgtcattgtggcgacaatggcgtcgatatccccgttttgcagcataggaatccttgtttttgaggtgacctctttaaattcagcttttttctcatcacctaaaatgtctttagcgatttgtttggcaatatcaatatcaaaaccctcaatctcacctgagcttggatttttaagaccgaacagtcgagtgtccgtttttacgccgaagacaattttgtcattgtctttaatggcggctagcgtatcttttttgctctcctttgaggcttctccgtttgatcccttgctgccgcaagcggcaagcaagatgacagcgaataaagaaatcaatgctaaagaaaaaatctttttcatacaagctcccccatttctgttttaatgatttaaaatacggcttaagaataagcgggcccgttcttccttcgggttcgcgtaaaattcagccggcactgcttcttctaaaatttttccttcgtcaatgaagacaatccgatcggcaacttctttggcaaaccccatttcgtgtgtcacgacaaccattgtcatgccttctttggcgagtgttttcatgacatctagcacctcaccgatcatttcaggatcaagtgctgatgtcggctcgtcaaacagcatgacctccggcttcatcgccagtcctcttgcgatggcaacacgctgctgctgcccgccggaaagctgggaaggataggcgtcagccttgtctgggatgccgactttttcaagatagtaccgcgccgtttcctttgcttgttcaggtgattgtctaagcacttttaccggagccagcatgatgttctgcagcactgttttatgcggatataaatgaaagtgctgaaacaccatcccgatattttgccgcacttgattgatatcagtttttctgtcgttaatggcggtgccgtttactgtaagcactccctcattgatcgactcaagtctgttgatgcatctgagcaatgtgcttttaccggaaccggatgggccgatgataacaacgacttcacctttttcgatttgaagattaatttgttttaacacgtgaaaatctccgtaatgcttgtttacattttgaaatgtgatcatcgcaatcctcctatcagaaaatttgaccaaaaagtaaatgatcaaacttttctgaaaattaaaagtgaaaaaatgtccatgacttctgactgactaaagaaacataaagaataattccttgtaaacctcaaaagatataggtgaggtgaaagcagatgctccaaaaaccggtgcagcttttgttgtgggtggctatttgtttgctggttctgttaacagtctatgtcttttttatgcttgatatgttatggtcacccttttggctcgtcataaaaacgatctttattcccttgatcatttctatttttatatcttatttattgcttccggtcacagaatggctgcatggcaaaggattgcctaggactttgagcatcttggtcatttatgttcttttttttggcgggattggctgggcgttgtataaaggggtgcctgttttaatcgtgcagctgacggatttgtcagaaaatatacccatgtttgccgaaacgtataacgggcttcttcttcatgtgcataaccatacggatgactggcctgatggtatgcatcaccgtatagataaaatgatccgccagacggaggcgttttttgcgggaacgatcgagggtgcgatcagcgggatccgcaatgtgcttgattacttcttaattgctgcaacaatcccttttctcgtgttttatatggtgaaggacattgagttaatgaaaaagacagtatggtacttgactccgaagtcgtggagaaagcggggcagcgcctttttgcgggatgtggatgattcgcttggcgattatatccgcggccagcttttggtctgcttgattcttggcgtgattgcaggcatttcgttctgggtatttgggcttccgtatccgctgatacttggccttatctctggggtaacgaatgtcatcccgtattttggccctttcatcggagctgttcctgcgttgttaattgcgatgacgatctcagtcaaggcggttcttgttgtggtgattacggtgtttattctgcagtttatggaaggaaatatcctcagtccgttcattgtcggcagaagccttaaaatgcatccggtcgttatcatgcttgcactccttgccggaggggagcttgcgggtatcgtcgggatgattctggctgttcctgcgacggctgttttaaaagtaatgatgatccattttttgcggatgaggacggagcattgacatcggcgtgccgcttgtctataatttctcgtagaatacatacgaatctcgagtgacggatctgagtacgccgaagccctgttaaagagagaagctccataagctgaaaggagctttatcagaagatcggaggaagctaatcctgagtgcagttaatcactgccgcttatcctgcgttacagggttaaaggtgacgggcgcatgaatgcccgtaatcagggtggtaccgcgagacagctctcgtccctgtgtaaacgttggtttgcatagggggagggcttttttgctgtcactgaagagaatttcgatttttatagaggaggaaatacaatgaaacacttaacttctgcggaagtgcgtcaaatgtttttggatttctttaaagaaaaaggacatgcggtagagccaagcgcgtcattagtgcctcatgaggatccttcactgctttggatcaacagcggtgttgcgacgctgaaaaaatattttgacggccgtgtcgtgccggaaaatccaagaatcgtaaacgctcaaaaagcgatcagaacaaacgatatagaaaatgtaggtaaaactgcgcgccatcacactttctttgaaatgctcggaaacttttccatcggcgattatttcaaagaagaagccattacatgggcttgggagtttttaacgagcgacaagtggattggcttcgacaaagagcttctctctgttacggttcatcctgaagatgaagaggcatatgagttttgggcgaaaaaaatcggtattcctgaagaaagaattatccgtctggaagggaacttctgggatatcggtgaagggccgagcggaccgaatacggaaatcttttacgaccgcggtgaagcatacggtaatgatccagaagatccggagctttacccaggcggggaaaacgaccgttacctggaagtatggaaccttgtgttctcagagttcaaccataaccctgacggcacgtacacaccgcttccaaagaaaaatattgatacaggcatgggtcttgaaagaatggtatctgtcatccagaatgttccgacaaactttgacaccgatttgtttattccgatcatcaaagcaacagaatcgatttctggtgaaacatatggcaaagacaatgtgaaagacactgcgtttaaagtgattgctgaccatatcagaacggttgcctttgctgtcagtgacggtgcgctgccgtcaaatgaaggccgcggctatgtattaagacgcttattacgccgtgccgtgcgttatgccaaaacgatcaacatccatcgtccgttcatgtttgatttagtgccggttgtcgcagaaatcatggctgatttctatcctgaagtgaaagagaaagcggatttcatcgcaaaagtcattaaaaccgaggaagaacgcttccatgagacccttaatgaagggcttgcgatcctgtcagaaatgatcaaaaaagaaaaagacaagggcagcagcgttatctcaggtgctgatgtgtttaaactgtatgatacgtatggattcccggttgaattgactgaagaatacgcagaagacgagaacatgacggttgatcatgagggttttgaggaggaaatgaaccagcagcgtgaacgggcaagaaacgcccgccaggatgtcggcagcatgcaggtgcagggcggcgcactgcgcgacgtgacagatgaaagcacatttgtcggctactctcaaaccaaagctgatgccaatatcattgtgcttcttcaggacggccaactaatcgaagaggctcatgaaggagaaagcgttcaaatcattcttgatgaaacaccgttctatgcagaaagcggcggccaaattggcgataaaggctatctccgaagcgagcaggcagttgtaagaattaaagatgttcaaaaagcgccgaacggccagcatgtgcatgaaggtgttgtggagagcggtactgttcaaaaaggcctgcatgttacggctgaagttgaagaccatatgagaagcggcatcattaaaaaccacacggcaacgcatttattgcatcaggctctaaaagatgttcttggaactcatgtcaatcaggcgggctctcttgtaacggaaaaccgtcttcgttttgacttctcgcactttggccaagtaacaaaagaagagctcgaacaaattgaaagaatcgtaaacgaaaagatctgggcgagcatcccggtcagcattgatttgaaaccgatcgctgaagcaaaagaaatgggtgcgatggcactgttcggcgaaaaatatggcgatattgtccgtgtcgttcaagttggagattacagcttagagctgtgcggcggctgccatgtcagaaatacagcagaaatcggcttgtttaaaatcgtttctgaatctggaatcggcgcaggcacaagacggattgaagctgtaacgggacaaggcgcttacgtcgaaatgaacagccagatttctgtattgaagcagaccgctgacgagctgaaaacaaatatcaaagaagtgccgaaacgggtcgcggctctgcaggctgaactgaaggaagcgcaaagagaaaatgaatctcttcttgcaaaactaggcaacgtggaagcaggagcaatcctgtcgaaagtaaaagaagttgacggcgtaaacgtgcttgcggcaaaagtaaatgcaaaagacatgaatcatctccgcactatggtcgatgaactcaaagcaaagcttggctctgcggtgatcgtgcttggtgcggtacaaaacgataaagttaatatctctgccggagtcacaaaggacctcattgagaaaggacttcacgccggcaagctggttaaacaagctgcggaagtttgcggcggaggcggcggaggccgtccggacatggcgcaggcaggcggtaaacagccggaaaaattagaagaagctttggcttctgtagaagattgggtgaaatccgttttataattcgcccatgtagtgtagaatgatggtaagattaggaccccaggctgaactttgcctgcgaatttgggaaagaggtgcaaaacggtgagctcgtttgataaaacgatgaaatttaatttctccgatgattctgctgagactaacgtaaatgaggtgctgattacagtgtatgacgcgcttcaggaaaagggctacaatccaatcaaccagattgtcggatacttgctgtcaggtgatcccgcttatattcctaggcatcgtgacgctcgcaatttaattcgcaaacttgaaagagacgaattaatcgaggaattggtaaagtcttatttagaacagcataaagaggcgtaaataaagaatgagaatattaggactcgatttaggaaccaaaacactcggtgtagctctgagcgatgaaatgggctggactgctcaaggccttgagaccataaagataaatgaagcagaaggcgattatggtttatcccgtttatctgaactgataaaggactatactatagataaaatcgtgctcggctttcctaagaacatgaacggaacagtcggcccgagaggcgaagccagccaaacatttgcgaaagtgcttgaaacaacgtacaatgttcctgttgtgctgtgggacgagcgtcttaccacaatggcggctgaaaaaatgctgattgcagctgacgtcagcaggcaaaaacgaaaaaaagtcattgataaaatggcggctgttatgattttacaaggatatcttgacagcttaaattaaagccagaggtgaagaaaatggaacacggcgaaaaaaatattacaattgttgacgatcaaggaaatgaacagctttgtgaagtgctgtttacatttgaaaatgaagagtttggcaagtcttatgtcttgtactatccaatcgaatcaaaagatgacgaagaagtagaaattcttgcttccagcttcacgccaaacgaagacggtgaaaacggtgagctattcccgattgaaactgacgaagaatgggatatgatcgaagaaacactaaacacattcttagcggacgaagacgaagagtaaaacatcgcgccaaaccaaagccggagctatactgctccggcttttttctgctttatgcaggcctctttttgtaataaattgccgaaatacaatgaatcatgtagtataagagctgatgggaggagacctaatgtatatcaatcagcaaaaaaaatcgttttttaataaaaaaagaatcatactgtcttccattgttgtgctgtttctcatcattggcggggcatttttatatgggaaatcattgcttgaacctgttgaaaaagacagtaaaacgacagttaatattaacattccgagcggttcgtctgtttcagccatcgcatcgatattaaagaaaaatgatgtcataaaaagcgagaaggcgtttcagtactatgtgaaatataaaggtgcttccgggtttcaggccggattctaccatctgaataaaggtatggatttagatgccattattcagaagctgacaagcggggctgcaggttacgcttttcaaatcacagtgactgagggagcacagctgacccaaatcgcggctgctattgctgatgaaacaaaatactctaaaaaacaagtcatagcgaagctggacgatgaaacatttatcaatcagctgaagaaagaattcccggacactgtgacaaatgatgttttcaataaaaacattaagcacccgcttgaagggtacctattcccggctacatacccttttaacgatccggacacatcacttgaagacattatcaaggcaatgattaagcagacaaattcttatgtggaaacatataaatcagaaatgaagaaaaacaaactttctgtgcataagctgctgacgatggcttctttgatagaagaagaagcgactgaaaaagccgaccgccacaaaattgcgagcgtcttttataaccgcctgaaaaagaaaatgccgctccaaacagatccgaccgtcctgtacgcggcaggcaagcataaagatcgggttctttataaggatctggaaatcgattcaccatacaatacgtataaaaacacagggctgacgccagggccgattgccaatgccggcatgtcgtcatgggaagcggcgctgcatccggataaaacggactatctgtatttcttggccaaatcaaatggtgaggtcgtatttacaaaaacgctaaaagagcataataaagcaaaagaaaaatacatttcctcaaaaaatgagaaataaaaggagagcaaaaagctctccttttgttcgctttccgcaaggttttatgataaaatatatcgggttgtttaccgatgtatcatgatgtattcagagagtgtcctgcgcataagactggggcactcctttttagaacgggaggctgtttgtagtgactgaccggtatgaacaaataaatgactatatagaagcattattaaagcctcggccggataacgtgaagaagcttgaagcatatgcagaagaacatcatgtcccgattatggaaaaagcgggcatggaggtgctgcttcaaattttgtctgtgaaacagccgaaaaaaatactagaaatcggaacggccattggttattcagccattcgaatggcgctggagctgccgtctgctgaaatatatacaattgaacgcaatgagaaacggcatgaagaagcggtaaacaatatcaagggatttcagcttgatgaccggattcatgttttttacggagatgcgcttgaattagccgacgccgttcatgtaaccgcgccttacgatgtcatttttattgacgctgcaaaaggtcagtatcaaaacttttttcatttatatgaaccgatgctttcaccggacggggtggttataacagacaacgtgctgtttaaaggtctggtggcagaggattacagcaaaatagaaccgaagagaaggcgcaggcttgtagcaaaaattgatgaatataatcattggctgatgaatcatccggattatcaaactgcgattattcctgtcggggacggacttgcgattagtaaaaagaagaggtgaacgtcatgaaaaaaccagagctcttagtgacgccgacgagtacagcggacattttgccgctcatacaggctggggcaactgcgtttttagttggggaacagagatacggcttgagattagccggagaattttctcgtgaagatgtaacaaaagccgtagagattgctcacaaagaaggggcaaaagtatacgttgctgtaaatgcaattttccataatgataaagtgggtgagcttggcgaatatctggctttcttagcagaagccggtgtcgatgcagcggtattcggcgatcctgccgtgctgatggctgcccgtgaatctgcgcctgatctgaagcttcattggagcacagaaacgacaggcaccaactattatacatgcaactactggggacgcaagggtgcggcgcgttctgtgcttgccagagaattaaacatggacagcattgttgagattaaagaaaatgctgaagtcgaaattgaaatccaggtgcatggaatgacgtgcatgttccaatcgaagcgttctttgattggaaactattttgaatatcagggcaaagtcatggacattgaaagaaagaaaaaagaatcaggcatgtttttacacgataaagaacgcgataataaatatccgattttcgaagatgaaaacggcactcacatcatgagcccgaacgatgtgtgcatcattgatgagctcgaggaattgatagatgccggaattgattctttcaaaatcgatggtgttttgaaaatgcctgaatacctaatagaagtcaccaaaatgtacagagaagcaattgatttgtgcgtggaaaaccgtgacgaatacgaagcgaaaaaagaagactggatcgaacgcattgaaagcatccagccagtaaacagaaaaattgataccggattcttcttcaaggaaacggtttattaatcaaaaggaggttaagctatgactgccgtaaatgataaaatatccacaatcgttaatggaaagcgtgtgattacgaaaaagccggagcttctcgcacctgcgggtaatcttgaaaagctgaaaatcgctgttcattacggagcggacgcggtctttatcgggggacaggaatacgggctgcgctcgaatgccgataactttacgatcgaagaaattgcagaaggcgttgaattcgcaaagaaatatggcgcgaagatctacgtaacaacgaatattttcgctcataatgaaaacatggacgggcttgaagactatttaaaagcgcttggagacgccaacgttgccggtattattgtggcagatccgcttattattgaaacatgccgcagagtggcgccgaatgttgaggttcacttgagcacacagcagtctctttcaaactggaaggctgtccagttctggaaggaagaaggtctcgaccgcgtcgtgctggcacgtgaaactagcgctcttgaaatcagagaaatgaaagaaaaggtagatatcgaaatcgaatccttcattcatggcgcaatgtgtattgcatattccggccgctgcgtgctgagcaatcacatgacagcgcgggattccaaccgcggaggctgctgccagtcatgccgctgggattatgatctctaccaaacagacggtgccaacgccgttgctttgtatggtgaagaagatgcaccttttgcgatgagcccgaaagatttgaagctgattgaatccattccaaaaatgattgaaatggggatcgacagcttaaagattgaaggccgcatgaaatccattcactatgtagcaactgttgtcagcgtataccgcaaagtaatcgatgcttattgcgctgatccagaaaactttgtgattcaaaaagaatggcttgaagagcttgataagtgcgccaacagggacactgcgacagctttctttgaaggaacgccaggctatgaagagcaaatgttcggcgaacacgccaagaaaacgacatatgattttgtcggcttagtgctgaattatgatgaagatacacaaatggtcacgcttcagcagcgcaatttcttcaaaaaaggcgacgaagtggaatttttcggtccagaaatcgaaaactttacacatacgattgaaaccatttgggacgaagacggaaatgagctagatgctgcccgccatcccctgcaaattgtcaaattcaaactagacaaaaagatttatccgagcaacatgatgagaaaggggaagtaacagcccatgggtaagaatccagtagtcattggaatcgcaggaggttccggttcaggaaaaacgagtgtcacacggtccatttatgaacagtttaaaggacactcaattttaatgatccagcaggacctttattataaagaccaaagccatcttccgtttgaagaaaggctgaacacaaactatgatcatccgcttgcgtttgataatgactatttaatcgagcatattcaggatctattgaattaccgcccgattgaaaagccgatttatgactataagcttcacacacgttcagaagaaacggttcacgtagagccaaaggatgttattatccttgaaggcattcttgttcttgaagacaaaaggcttcgtgatctgatggatatcaagctttatgttgatacggacgctgacttgcgtatcatcagacggattatgagagatattaatgagcgcggacgctctattgattctgtcattgaacaatatgtgtcagtggtccgtccgatgcataaccaattcgtcgagccgacgaaacgatacgctgatattattatcccggaaggcggtcagaatcacgtcgcaattgatctgatggtcacaaaaattcaaaccattcttgaacaaaacgcgattttgtaataccatagcatagacataaataactctgaccatattatgtataggcaggaagggaatgtgcgaattcccttctttccctgtttataaacgcgaaatatttgcagaacgacacgattcagtttaagataaacagtacctatatgggagagaagaacgaggactgccctgtgttctcattcttgtattttttagtttatgctctcatacataatcgaagatgttgagggacaaccagaaggagtgaagggacatggcacaagagaaagtttttcctatgactgcagaaggaaaacaaaaacttgaacaagaattagaatatttgaaaacggttaaacgaaaagaagtagtagagcgaatcaaaattgcgagaagcttcggagacctttccgagaactctgaatacgattcagcgaaagaagagcaggcatttgtagagggccgcgtgacgactcttgaaaatatgattcgcaatgcgaaaatcattgaagatgacggcggctctaacgttgtcggtttgggtaaaaccgtcactttcgtcgaactgcctgacggtgatgaagaatcatatacgatcgtcggaagcgcggaagctgacccgtttgaagggaaaatctcaaacgattcaccgatcgcaaaaagcctcttgggcaaaaaagtagatgaagaagtcacagtacaaacaccgggcggagaaatgctcgtgaaaattgtgaaaatttcataatatctgtttagcagcgaaacacctcgtccacaatgtgggtgaggtgtttttttatgaagatatcgaaacgaatgaagctggcagtcatcgcttttttgattgtattttttctgcttctgctgagacttgcagaaatccagctgtttttcacagaatcattttctaaaaagaaaattaatttgattcaagaaagtgtgaaacagcggacggaggaagtgctcatttcagatggaagaggctcttttttagatcgaaacgggcgggcgctgacgggacaaagcgagcctgcggttgttttgttcccttttctgctgacgcaggattggccgatcaaaaaagttgcggacatcctcggcatgtcagaagatgatttgcgccagacactaggtaaggcaaaaaaaccggtcattttgcagcaaaagaaaatcaaaacactttcaaaacaatctatcacaaaaatcaattctttgaaatatcccggcatttacggcgtatatatggagaatgaagacaagcccagccttgcttcacatacgatagggagcacgaaccaagatccggcgctgcttcgcaagaaatatcctgacaaggagagccttccgattacaacagaaatcggaacaaccggtttagaacggacatttgacgagtttttgcttccggaacaagacacaaagcttttatatcatgtggacggaaaaggaaaccctttgtttggcatggacgtcaaatatacagctgaagccaatacattttatccgctccaggtcaaaacaacgatcgatcaaagcattcaaaaagcgatggaggaggtattggatgaacaggggctgaaaaagggaggagctgtgctgctggacatcgaaaatagcagtgttctgggaattgtaagcaaaccagatgcagacgtgtcccggcaaaacacacttcaaaattatatgctgacgccaatctatcccggatcagtttttaaaacagtcattgccgcagctgcaatcgaaaataatatggtgaagcctagtcaaacctttaattgcaatttaaacctgtatggggaaccgggggacgacaaaggaaccttgtcttttgatgaaagttttgcccaaagctgtaattacacatttacgagtcttgcagaacaattaatgaaaaaagacagctcggttattgaagatatgtccgagaagctggctctcactgatcgggcaggctgggagggaaaactgtaccacgaaaccgatttccgccagctgtataacgaaaaaagcggcgtgatttggggggatgaaaaagacaaatcagtcaaaaaagccattgcgcaaacagcaatcgggcagaaaaatgtaaaggtaacgccgctggaggtagccaatatgatggcgacaatcgcccgcggcggagaaaaacggcaggtgaaaattgccgaacaaattgagtataagaacggcacaacgctcgttacgtttaaagatcagaagctcaaaggggaaacgatagacaaatatacgtcacagcagcttcaaaaaatactgcggcgggtagtagaatctccttccggaacgggcagaaggtttcaagatcttccgtatactgtagcagggaagtcgggcacagcccagacaggcaagctttcaaaagagaaggaaacgctctacgaaaaatggtttgccggatattttcctgcggataagccgaaatacgctctggttgttttacacatggatacaccgggagataaggctctgacaaattcggtgttttatgatattgttaaaaaagtacacgaaattgaaatcaatcagaaatagaacaacttctcagcacatgttaaaatatatgctgagccaagagggataaaggagtgcagaattattgagcaataatcaatctcgttatgaaaatcgtgataaacgcagaaaagccaatttagtgcttaacattttaatcgcaatcgtatccatactaattgtcgtagtagcagcgaatctcttcattaacagtccttctagcaaagatgtcagcaaggattctgaaacggcgcaaaaacaggaatctccggcttcaggaaagacggaaaagaaatcggatgaggatataaaagacagcaagaaagatacatctgacagcgaaaaggattctgagaagtcttctgactctgattccaaaaaagatgattcttcttctaaaaaagatgactctgattcagattcaagctcagattcagccggtgacgggcttaaagatgcaaaagtaacagaaggcggctcatcgagcgatgtggaaaaaacgtatgaaaatcctgactggaaagcagtcggaactgagcagactggcgagcatgccgctacttatgattcaagctcacaagactgggctgagatgctgaaagccatttcatacgcaactggtgtctcaacagataacatgacggtgctctggcttggaaataacggcagccctcaggatgccaaaggcaagattttggacaaggcgactgggaataaatatcaagtcacgattacatgggtcgatgaaaaaggctggaagccgacaaaagtagaaaagctaaaataaacaaaagcagccgggttacaaccggctgcttttgttttaggcttcagctgcgaaatgaaccaccgcgctgtacaatattcttccttctgccacagcagtttggtgtgaaacagatttcacccggagcatgatggctttattgttttcaatttgtgtattgattttcttttcaagctcctgcaatgaagccgcttcaaaaaattccactttgtctttaatcagatctaattgaaaattcatgtcttgaccctccagctttcacaagtcatatgaagtataagcttttttgcggtcaatgcgcaatatgagatggcataaaatacacaaagtgttttagtacctgcttttcagaagatgtggtattataggaactgttccatcattaatccatagtatacttataggaattattaaatatggagtgtgacaaatatgggccgtgaatttatccctctctttgaagattgggcagcaacttatgatcaaacagtacaaggtttagatattcagtataaagaagcgttcagaggctacgatcatatccttgatgccatcgtcagaaaatctggaacgcatgtgttagaatttggcccggggaccgggaatttgacagctaagctgctcgatgcaggcaaaactgtatttggaatcgaaccttctccagcaatgcgtaaactggcttctgacaagctctcaggcaggacggaaatcgttgatggagacttcctgacattccctgagccgccatttcaggctgatacgattgtcagttcatatgcttttcatcatttgactgacgaagaaaagcgggctgccataaagcaatatggcaaataccttcacttgcatgataaaatagtgtttgccgataccgtctttgaaaatgcgcaagcgtatcaacaggctatcgataaagcccgttctcaaggcttttatcagcttgcaaatgatttagagacagagcattatcctacattggatgcgttgaaagaaatgtttacagctgaaggttttgcagtccgattcactcagcaaaacgacttcgtgtggataatggaggcgatcaaacggtaaagtgaagggaatgtgaatagatgagactagcagtcatcggagcaatggaagaggaagttaccatcttaagaaacaaacttgaaaatgcaaaaacagaaacgatcgcacactgtgaatttacaacaggcgaatatgaaggaactgaagtgattcttttaaaatcaggaattggaaaagtaaatgctgctatcagcacgacgcttctgcttgaccgttacaagcctgattatgtcattaacacaggctcagccggcggatttcatcatacattgaatgtaggggatgtcgtcatttccactgacgttcgccaccatgatgtagacgtaacggcttttgactatgaatacggccaagtgccgggtcttccggctgcttatgcggcggatgaaaagctgatcagcatcactgaagaagcggtatctgaactcgacggcattcaggttgcaaaaggaacgattgcaacaggcgattctttcatgaacgatccgaagcgggttgaagaggtgcgtgcgagattttctgatctgtacgcggttgaaatggaggctgcggcagtggctcaagtatgccatcaatttaaaacgccgtttgtcgtcatcagagcgttatcagatatcgcaggcaaagaatcacatgtttcatttgaccaatttttagagcaggcggctgttcattcaacagagcttgtgttaaaggtgatcaaacgaattcattaaaacggggagaacgttctcctccgtttttctctaaaaacaacctctattaaggaggaggacatatatgacagtgattacggacattaccgagctgattgggaatacaccgcttctccgcttgaagaactttgatgttccagaaggagtcgcggtgtatgccaagcttgaaatgatgaatccagggggaagcatcaaagacagactgggagatatgctgattcgtgacgcgctcgattcaggcaaagtgaaacccggcggagtgattatagaagctacggcaggcaatacagggatcggccttgcgttaagtgccagaaaatatgggctgaaagcgattttctgtgtccctgaacatttcagcagagagaaacagcaaattatgcaagcgcttggcgcatcaatcattcatacaccgcgtcaagacggaatgcagggagccattcaaaaagccattcagctggagactgaaattgaaaattcttattgcgttttgcaatttaaaaaccgagtaaatccatcgacttactataagacgcttggacctgaaatgtgggaagcgcttgacgggaatattcatacatttgtcgcaggggcaggatcaggaggcacattcgcagggacagcttccttcttaaaagaaaaaaatccagcagtcaaaacggtgattgttgaaccggtgggctcgattttaaacggaggagagccccacgctcataaaacagagggcatcggcatggagtttatccccgattatatggataagagccattttgacgagatctacaccgtaacagatgagaatgcgtttagacttgtgaaagaagcggcagaaaaagaaggcctgctgatcggaagctcttcaggtgcagcgctttatgcggcattggaggaagcgaaaaaagcatccgctggaactaacattgtcacagtatttcctgacagcagcgatcgatatatcagcaaacaaatatacgaaggaggcatctgatatgaagaaaaaaacattgatgatacatggcggaatcacaggtgatgagaaaacaggcgcagtttccgtgccgatttatcaagtaagcacgtacaagcagccgaaagcagggcagcatacaggctacgagtattcaagaacggccaatccgactcgaaccgctctcgaagcacttgtgacagaactggaaagcggggaagcaggctatgcgttcagctcaggaatggctgccattacagcggttatgatgctgtttaacagcggagatcatgtcgtgttgactgatgatgtgtacggcggaacatatcgcgtgatgacaaaggtgcttaaccgtcttggcattgaatcaacatttgttgatacgagcagcagggaagaagttgaaaaagcgattcgccctaatacaaaagccatttatattgaaacaccgacaaacccgttgctcaaaatcaccgacctgacgctcatggctgatatcgcaaaaaaagcgggtgttctgcttatcgtagacaatacctttaatactccttattttcaacagccgcttactttaggcgctgatatcgtactgcacagtgcgacaaaatatcttggcggacacagtgatgtcgtcggaggtttagttgtgacagcttcgaaagagcttggagaagagctgcattttgtgcaaaactccacaggcggcgtgctcggccctcaagattcctggctgttaatgagaggaatcaaaacgttgggactcagaatggaagcgatcgatcaaaatgcgcggaaaatcgcaagctttcttgagaatcaccctgctgtccaaacgttatattaccctggttcttcaaatcatcccggacatgagcttgcaaaaacgcaaggatcgggcttcggcggcatgatctcctttgatattggcagtgaagaacgggttgatgcgtttttaggaaatctgaaactgtttaccattgctgaaagcctgggggcggttgaaagcttaatttctgttcctgcaagaatgacacatgcctctattccgagagaacgccggcttgagctcggcattacggacggcttgatcagaatttctgtaggaattgaagatgcggaagacttgttggaagatatcggccaagcgcttgaaaatatataacaaatggatagaattactttctctgtaagccgccggattatattataatagtcgtatactatgaatctggcaggtgattcttttgaacaaaaatagaatgaaatctttaaaagaagactacaagcattttgcttttacattgcttgcagtcagcacttttttatatataggcgcagttctccctgatcaaggtttaacattaggccagaaatcgacgatgtttttagcggattgcgtatttttagccggtgccttcttttgcgctgaccgttcacttatttacaagaagcgtctggaagaagccgacgaataaaaaaacagccatcatcagagatggctgtttttctgttattgttctcgaagttcttttcccatgccttttaaaaactgaaggccgaacccgacggctctgttgatgtcaggatcgttcattgcttttaacaggtcgagaatcccgactttcttgtcttcttttaaaaagctttgtgcctgttcagtcccagccattacgctttctaaaagctttgctgtaaactcaggatcggcttttgtcaatgcgcctccggcggccatcatcgtgttgatgaggttggtgacaggctcgcgggaaacttggccaagcgcaatcttggcaatgtcttccttcgctctgagcatgcttgttgccgcatcaaaaattccaagatcattgagttcattcattaacgtcatcgttttagagacggcgtcctcattttccgccagcagctctttcagttcttctattttttcaagcttaatttgctcagctgtttttgtttcttttttgatcgtcgtaatcggagtggccattcgttttcctcctatcgtttaatcagtcagatgtacatagccagggcggttccattttctttctgcttcgactccgttttgcggatgccgttttttgttgcgcggatttgtttttggaagcggcgctgtttcacagccgccaagcacttccatgcggacctttgtctgtttataagcaggcgtgttcgtccgtttatcagctgcagggcccgtcaagaagttaatcgctgactccttgtctgtcgagttcattggcaaatagagttcatttttccgtacccggtctgtgatcagcgcgttcaatttgactgctccgaacggagaaacgagccgtacaagcgaaccgtcacaaacacctcgctcttgtgcaagctcaggtgagatctcaacgaatacattcggcactttcgcttggatgcctttcgatttatttgtcatgtttccttcgtggaaatgctccagcatccggccgttattgatatgaaggtcatattcctccggaaatgccgctggctcggtccaatcagaaagggcaaagcgggcttttttgtcagggaaattaaatccgtcttcatacagaagcggtgtgctttcacctgtgaagctgccccataggaagctgttccagccttcaagcacctcatagcttgctttggcaaacagaggagaaagactcgccatttcagagaaaatgtcacttggatggctgtaattccaattcgctcctaaacggtttgccacctcttgaataatccaccagtccggttttgcgtcaccaagcgtcggaagcgcctgatacaatcgctggacacggcgttctgtgttggtaaatgttccgtctttttcaagtgaaggagtggccggcaagacgacatcagcatattgagctgttcttgacaggaagatgtcctgtaccacgaagaaatcaaggcttgataaaatatcatgcacatggttcgcgtttgaatcgaccagtgccatatcctcaccgacaagatacatagctttcatttttccttcttcaatggcatgaagcatttgaatattatctaaaccaggctttccatcaatctcgacaccatatgcctcttcaaatttagcgcgtgctttgtcatctgtaatatgctgatatcccggcagccagccaggcaatgttcccatatcacatgcgccttgcacgttattgtgtccgcgcagaggataagcgccggcacctggacggcgatagttgcccgtagcgagaagcaggtttgaaatggctgctgatgtatcagaaccgcctgtattttgtgtgacacccattccccaaaggacacaagtgccgtcagcatcacgaatcatttcagcaatttgaatgatgttttcttttgaaaggcctgtgatgcgttctgcataatcaagcgtatacgttttaagggtttctttataatcttcaaagtaattgacgttctcatcaataaacgcctgatcgtgccagccttggtcgatcatatatttcgtaacagccatcagccaaacttggtctgtgccttgtttagggctgatgaacagatcagatcgctcagccatctcatttttacgcaggtcagcaacaatcagtttttgaccgtggagcttgtgtgcccgtttgacgcgtgttgcgagcactgggtgtccttccgccggattggcaccgacaatgatgaccaggcctgctttggcaatatctttaatcgtgccggcgtcaccgcccatgccgacagtgcggaacaatccgtctgtagcaggagactggcagtagcgtgagcagttatcgacgttgtttgtttcaaatacctgacgcgctagtttttgaatgacgtagttttcttcattcgtaattttagaagaagaaataaaccctacagagcctttaccgtactgctctttaattgatcctaatctgcttgcgacaagatcgagggcttcttcccaagaagattccacaaaggctccgtttttacggattaaaggctttgtgatccgctcctcagaattgacaaaatcccagccgaatttccctttgacacatgtggaaattgcgttaaccggagcatcagaaacaggctggatctttaaaatatcccgtccttttgtccatacttcaaatgaacatccgacaccgcagaacgtacatacagttttcgtttttttcgttctcgtttcacgcattgccgcttcgacttcagaaatggcaaaaatgctgccataccccggttcaacatttttcacgagatcaatcatcggttccatgacgtcctctttaatgcctgtcataaaaccagcctgcccgagcattgatttttccatcagtgcattacatggacatactgttacacactgaccgcagctgacacaggaagattcattgatcggaactccctcatcccaaatgacgcgagggcgttcgcgttcccagtcgattgagagtgtttcatttacctgaaggttttgacagacctcaacacactggccgcaggcaatacattggtttggatcatagcggtaaaaaggatgagacatatcaaccgcgcaagaaggatcttcttttggcgtgtatgggtatttttgatgctcgatccccatcatttccgctgtattatgtagcgtacagtttccattgttgttatcgcaaactgtacaatacagcaaatgattttcaagaaggcggtccatcgcttcggtttgcgcttctttcactcgatttcctgaaagatcaatagacatcccgttttctgcaaccgtcgcgcatgaacgaaccagcttgccgtttgcctctactatgcaagtatcacaagtttgaatcgggtcaacctctggtacgtggcaaatctgcgggtactcaattccgttttcatttaaaatatctaaaattgtggcccctgctcgtgcttgaatttctgttccgtctacacggacactgatcgacttaacgtccatcatattcatattcccctccatctttctttcaagaagtcaaaaaaagccatgtatagatacacctgcccttaattctaagaaggtgtaaacacacatggcggaatagttcactagcaagtcttactaacagaccaatccttgatttttataaaacgatagactcataacaagatcctattacaaatccatcaacactgcttttattataatgtgatatttattataatacaatatggcaggaaaattttaaccaagtgaaatgtcctgaggggaaccgggaaaagcctttataaggcaatatcggaaggggtaatcagcatgtctaaaaaaattcatgaattcaatgatattattcgaaaacttcgcaaagaattgttcggaaaagggcctgagagaattcatactgtatttgtagaaaacatggcagtttcaacactatacggaaatctgagtgcaagcgagcagtttattgcccgcacgcctgaaggaagagagatggtacatgcggcccggacaagcctaattcaagacctttattccaaacaaacaccggaaggaatggaggaacttatgggagctaagctagtccatttgttttctgatattaaaattgaggaaaacatcgctgtatctgtatttgtttttgaccgaaaaatagatgagcaaaaagaagctctgcaaagctagtatatttgtcattgacacaaatttgtcacatttgatatgatgttgctacagttatagaaggctaaagcaatggaatgtatgcacgaactgtatatattctctttcaatatcttatatactgcttgatattgttgtatgggtatgcatacaagttaggcagcattcaaacgcctggtttgacacaggttatttgagtgctgccttttttattgcctttcttgcataactgtgagaaaagaagaagtaatggaggcgttttattatggcttttcgaaaaccggatgaaatagcggaagcagcaattgaagcagggatgaaaaaaataaagctcccgctgccgtcactgcttgtgctggggtttttaggcggtgcatttatcgcgcttgggtatttgcttgatatcagggtaattggcgatcttccgaaagaatgggggagcctgtccagtttgattggtgcagcagtatttccagtcggcctgatccttgtcgttctcgctggcgctgaactgatcacaggcaatatgatgtcagttgcgatggcgttattttcgagaaaaatatcagtaaaagagttagtgattaactggggaatcgtcacaattatgaacttaatcggcgcattgtttgttgcttactttttcgggcatttggttggattgactgaaacaggtccttatttagaaaaaacgattgccgttgcccaaggaaagcttgatatgagctttggcaaggttctcatttccgccatcggctgtaactggcttgtatgtcttgcagtgtggctttctttcggcgcccaagacgcagcaggaaaaatccttggcatctggttcccaatcatggcttttgtggctatcggatttcagcacgttgtcgccaacatgtttgtgattcctgctgccatttttgcaggctcattcacgtgggggcagttcatcggaaacatcattccggcttttatcggtaatgtcatcggcggagctgtatttgtcggtctcatttattttattgcatatcataagaaagaccgctccagaaaagaaatgaagcaggtgtcatgaccaacgggcaaatccattcgatgatttgcacaatttccgtccatttttagaaaaagatgtttacaaaatggaatttggtggatatacttacaaagtaagaaaaaaagcaaaggaggctgaaccaaaatgacaatgagacaacgacgtcaacctgtacgtgatacacatgtaaaagttcatggtttattcagcctgtggaagagttcgtgtccttccttaaccgatgcttatcgcacgcattaaattcggaatagtcggacatacgcaactccccgcaggcagtagaggcattggtgtcttctttgtctgcggtttttatttgcccgcggcagaaggggtgtgccgcgggttatttcgcttgatgcggactttgaaagggggtgagcgatatgacgattaacctattctttttaacgttaacgataaaaaaaaggtttaaaagcctggaagaattcgaacgagaacagcagattgagcagatttatgatgaaatgaaagagtctcagttaaagcatctttatttaacaaactggcgctaaaagcaacgaaaaaaactgaagggggaatggcatatgcttagaagggaattattgatgcattatacaatggagaaggaccaagtttagcgaaatagctgtcaagaaaatgcgcgcctgcatatagtaaatcaacgttattgtgaggcaggtgatggcatgatgaacgattatcaaaaaagactgccgtcgattggccatggttatgcgtccatgccgcattccttcaaacatggttatggaaatccattccgacagcagaggctgatggcaatgcagcagcaaaggctgtatgtattcccttatcattggcattagaaagagggcagaaaacattttgttttctgcttttttttcggaaaaaaatgaaaaagtttagttctattgaaacatttttcaatacattgccgtctagttggtaccttccttcacttttagaaatgaagatgatgtttatttttttaagataataaataaacataggaaaccaaaagcaggtgtttaaaatgctagaaaatagactctataaacgatcggatttttggaaattattttctcggaaatataagctaaccaaaacaattgagcatatgatgattgactctatagatatacaagaaaatgacagaattttagaaattggaattggaaacggcactgtctttaaaagcataaccaagaaactagaaaagggaagcctaaaaagcattgatccttcaaaacgaaaggtaagacagatatcacgtgcgaatcgaaagaacatggggaacggggaagtttttcatggctatccagaggacattccctttgatgaccgtacctttaataaagtcttttctttacatacggttcaaagctgcaccaatattaggcttgcattaagagaaatttacagggtgcttcaaattgacggccggttttatatcagtattgacacaaataccggtgaaaaagagaaaacgtatattcaactgctgaaagaccagcatttcagggatctttctgttatcaggcgtgattcctgtctatgtattgtggctgttaaataaaaaatttctcgggaaatatatccaagatccttacatttagatttgggtatattttcttaattttttattttttgcatatactttatattaaaaaaagtttttttcatttaaacttataacagaagagagaacaaagaggtgatttcagatagggcagacattctttgtgaacaaaaggaatgaatattcattccgcaacgaatcggaggttgtaacattatatgctatccgcatccagcagtaaatacgacatgattatgaaagcgtcggtctcactttttacggaaaggggttttgacgctaccactattcctatgatagctgaacgtgctcatgtagggacaggaacgatctatcgttattttgacagcaaagaaacactcgtaaacgtgctgtttcaagaaagcatccagcgatttacggaaaaactgaagcaagacgtttcagaattgcctgtcagagaaggctttcaccacgtattttgctgtctcgttcagtttacgaaagagagcgactatgcgcttttttttcttgaaaccaaaaaagacgctcattacttaaatcatacaagcaaaaaaatgatagaaaatctgactcaaatgcttgatgactattttaataagggaaaagcggaaggcgtgattcgcagcctgccctctaatgtgttaattgcgattgtattaggggcgtttctcaagatatatcagctcgttcaaacaggtgatatagagatggacactgatttaattactgaattggaacaatgctgctgggacgccattaagcttcattcatcacaaaaataggaaagggagatgttaatgaaacaggcaagcgcaatacctcagcccaaaacatacggacctttaaaaaatcttccgcatcttgaaaaagaacagctttctcaatccttatggcggatagctgatgaattggggccgattttccgttttgattttccgggagtatccagtgtttttgtatcgggccacaatcttgtggctgaagtgtgtgatgaaagccgctttgacaagaaccttggcaaaggcttgcaaaaggtgcgcgaattcgggggagatggcttatttacaagctggacgcacgaaccgaactggcaaaaagcccaccgcattttgctgccgagttttagtcaaaaagcgatgaaaggctattattctatgatgctggatatcgcaacccagctgattcaaaaatggagccggttaaaccctaatgaagaaattgatgtagcagacgatatgacacgtctgacgcttgatacgattgggttatgcggatttaactatcgattcaacagcttttaccgtgattcacagcatccgtttatcaccagtatgctccgtgccttaaaagaggcgatgaatcaatcaaaaagactgggcctgcaagataagatgatggtgaaaacgaagctgcagtttcaaaaggatatagaagtcatgaactccctggtcgatagaatgatagcggagcgaaaggcgaatccggatgataacatcaaggatctcttgtctctcatgctttatgccaaagatccagtaaccggtgaaacgctggatgatgaaaacataaggtatcaaatcatcacatttttaattgctggacatgagacaacaagcggtttgctttcctttgcgatttattgtctgcttatacatccagaaaaactgaaaaaagctcaggaggaagcggatcgcgtgttaacggatgacacgcctgaatataaacaaatccagcagctcaaatacactcggatggttttaaatgaaaccctcagactgtatccaacagctccggctttttctctatatgcgaaggaggatactgttctaggcggggaatatccgatcagcaaagggcagccagtcactgttttaattccaaaactgcaccgggaccaaaacgcttgggggccggatgcggaagatttccgtccggaacggtttgaggatccttcaagtatccctcaccatgcgtataagccgtttggaaacggacagcgcgcttgtattggcatgcagtttgctcttcaagaagcgacaatggttctcggtcttgtattaaagcattttgaattgataaaccatactggctacgaactaaaaatcaaagaagcattaacgatcaagccggatgattttaaaattactgtgaaaccgcggaaaacagcggcaatcaatgtacagagaaaagaacaggcagacatcaaagcagaaacaaagccaaaagaaaccaaacctaaacatggcacacctttactcgttctttacggttcaaaccttgggacagctgagggaatagccggtgaattggctgctcaaggccgccagatgggctttacagctgaaacggctccgcttgatgattatatcggcaagctccctgaagaaggggcagtcgtcattgtaacggcttcttataatggggcgccgcctgataatgctgccggctttgtagagtggctgaaagagcttgaggaaggccaattgaaaggtgtttcctatgcggtattcggctgcgggaaccggagctgggccagcacgtatcagcggattccccgcctgattgatgacatgatgaaagcaaagggggcatcgcgtttaacagcgattggggaaggtgacgccgccgatgattttgaaagccatcgcgagtcttgggaaaaccgcttctggaaggaaacgatggacgcatttgatattaacgaattagcccagaaagaagacaggccttcattatcgattacttttctcagtgaagcgacggaaacgccggttgctaaagcatatggcgcgtttgaagggattgtgttagagaatcgagaactccagacagctgccagcacgcgttcaacccgccatattgaattggaaattccggctggtaaaacatataaagaaggcgatcatatcggaatcctgccgaagaacagcagggagcttgttcagcgggttctcagccgattcggtttgcagtccaatcatgtgataaaagtaagcggaagcgctcatatggctcatctgccgatggatcggccaatcaaagtagtggatttattgtcgtcctatgtagagctgcaggaaccggcatcaaggcttcagcttcgggagctggcctcttatacagtttgtccgccgcatcaaaaagagctggaacagctcgtttcagatgatggcatttacaaagagcaggtacttgcaaaacgtcttaccatgcttgattttttagaggattatcctgcctgcgaaatgccgtttgaacggtttttagcacttttgccatcactaaaaccgagatactattccatttcaagctcaccgaaagttcatgcaaatatcgtgagcatgacggtaggagttgtgaaagcctcagcatggagcggccgaggtgaataccggggtgttgcctctaattacttagcagaattgaatacaggtgatgcagcagcctgcttcattcgtacaccgcagtccggattccagatgccggatgagcctgaaacgcctatgattatgatcgggccgggcacaggaattgcaccattcaggggctttattcaggcaagatcggttttgaagaaggaaggaagcacccttggtgaagcacttttatacttcggctgccgccgcccgggccatgacgacctttacagagaagagctggatcaagcggaacaggacggtttggtcacaatccgccgatgctactcgcgcgtcgaaaacgaaccaaaaggatatgtccagcacttgctcaagcaagatacgcagaaattgatgacactcattgaaaaaggggctcatatttacgtatgcggtgatggatcgcaaatggctcctgatgtagagaaaactttgcgattggcgtatgaagctgaaaaaggagcaagtcaggaagaatcagctgaatggctgcaaaagctacaagatcaaagacgttatgtgaaagacgtttggacaggaatgtaaaatataaaatcccgccaatctgattggcgggattgctttgcatatgagaaaaccggcacgataatgaaatctactgaaaaggatgttatagggagtatcgcgccggccttattattcatatcgtcatgcagaggcaaaagtttagttctttttaccttatttttaaaaataaatagtctaaaagtcttgttttcgattttcaactcaggcttttggcattttgttctttcttattccttaagatcagtcatctgttgaagattgatgcttgaattgccgttccacatgtttacggtaatgaaggtcatgaatcagccgaatggtcggcctgattaacagcagctaacttccgaccgcaaacagccatatccctgccgactttaaacggtcatagaaaaagaaaaagcttccaacgaggaacaaagcaccgatgataaaatcgtttactgtataaagaaccttatatcgttttttgaaaaaaagctcatatcgtttcagctctttttggatgtcatgttcttcatttcctttcattatcatccctccattcaattttggcttacccttacgtaaacggcatgtaaacataagggctgccttgctgaaagaagacataatcaacgatcagaaactaaagtaaaaaagtgatccgtataggatctcttttttacgatttcatcgcctgaacaataagagcagtcaaagtttttgcccctttaggaaccaagtgaacaccatcaggggtaaaatattccggatgctgaagagcttctgtatgccagtcaactaacgtaacattttgatgtgcgtgggcctgttgctgcaaagattcatttaccttgctttcccattggcggggaacccgtgtattgacaagataaatatgagcttttgagaaagattgaagcagttgttcgatttggctgtttgtaaaatagccattggttccaagctcaatgatgacagccttgttcggctgattaaaagacttgtattcccttgcgagttccaaagcttgagacatttgtctccctacctttccatcaatcgtcacatttgaaaatgactgacgcaggtgtgaagaaatatcaagcatgacggaatctcctatagctaaaacttctttcgcagtgtctgctggttttttctgctgttgggattgcgtgtctttctttttatgagtctcttgcccactatctttgttttccttttgaccctgattggaatctgttgtcttttgttcaggattgtgttttttatctgctgcagcgttctttttatccccagaagcctggctggtgtcagcatttgtttcttgtgagctataggtccatttggtagggtgcttttgctcgccggctagccctgacagcccgcctgcaaaaataagtatagcgaaaataatgaaaccaattgacattttgctgatgacagatgtcgttttccattccttgattctatgtataaaaacacggcgggaaaatgacctaaatccctgtgtccgtatcggcttctcaataaaatggtaggagagctcggcaagtatacatgtcacaatgacctttagcacgatatgccaaaaaacagggtttccgatttcttgaactggcgtgcttaacacaataacagggtagtgccaaagataaattccgtaagacctcgttccaagccaccgaagcggcctccatgaaagcagattgcctaaaaagctgctcggatggcaaacacatgcaataaggattgcggcagtcacgctaatgaatagcattccgcctctgtaaagaaaaggctcgtattcatctgtgaaatagacacacaacactaaaatacaaaatgccaaaaattcagtggcgtgcaaagtgtgcttcagtttgcttggcagcctgttggaagacagccttttcatcggccataccaaagccaaggcacatccgatgagaagttcaaacgaacgagtgtctgtgccatagtaaacgcggctcggatctccgccaggttcatacagtacgctcatcatcacggctgaacaaagcacaagcaatgatatcaccgcagccaatctggcgcggcttttcattatgtacattccaacaactaaaaacatcggccatatgatataaaattgttcttcaatcgccagcgaccaaaggttttttagaggtgatggggaaccgaaactatcaaaatatgatagcttgtgaaaaataaaccaccaattgctcatataaaagagagaagagatcgcatctccacgtacagtgtgtaatagttctcgatcaaacaatacgacccacacaacagtggaaaagatcataaggtaagccgctggcataagccgccgaatgcggcgcacccaaaaatcccgaaaatcaagattgatatcatttccatatgccggtaatagaatagatgtaatcaaatatccggataaaacaaaaaagatatcaactccgataaaaccaccgttagcccaattgaaatttaggtgataagcgataactgacaggacggcgaaagcccgaaggccatcaagtccaggaatgtatcgatgatgctgtgtcttgtgatacatgggtattcctccaatagtatgcaaatattctcgttgtttttggtagcgaggttacgacctcgaatagagaagagagaaaacatccataatcttagatggatgtttttattttatcgaatataacgttctcccacgagcaagtttgaaatgacacgggttggaattgtaaactctgtaacgcccatatagccgggggcgacttcatattcgtcaaatgagatcacaagtttatggtcttcagtaatgtaaaacgtctgatcaggaagaatcgttttgaacggttctgcatcttcgtcagtgagccaatatattttatttggatcttccttcatttgctgtttcatttgctctctaatattttgactgatgactttgatatagcgctcatctttgaataagctttttaatgtaagtaaaatatcattctttttgtcaattgtaatataacggctttgtgtgtaggaagatgcttgtgttgtttcaatattgcgccggatagagagtaaatctggcgtgtctgtgaccgtctcgtaatcactgtagatgctgagatgcccttttttgtttttggatgtggactgtataaactctttatacagctgctggctttctttcaagtatttttggttaatgctgttttccagctctttattagaaagcccggacaaagcaggtgttttgacatcaatgcttgattggtctttttcctctttgatttcaataaaggtgatcgctttgacgattttgccgatgacagggatctttgacatagcctgagcagcgtcagggttgatattaacaagcgcagtgaataaaatagctgcagcgattgctgctgatgtcggccacatgacgattcttttcttttttggttcttgctgaagggctttttcaacaatgatatccaattctttaggaatcggaacatttttatattcttctcttaattgctgtaatctcttatccattaagaaagatcctccttcgtcaactgaatgcgcatcagcttcaatgctctgtataggcgcgttttgacggtattcgtgttttctcctgtaatttccgcaatttcttctaatttgaggtcttcaaaaaaacgtaaaataataacggttttatagcggtacggcaattcgtcaagcgcttcatagagatcagtatccttgtaatggtcttcctttcctttgcttaaaaattctatcgtttcgtcgtccatcactcttatctttttttgtttgcgcaaaaaatcaatggctgtccgcactaaaattttataaaaccagctttttatcgtctcagggttcctgaccgtttcaactgagctcagcgctttttttatcgattcctgaacaatatctaatgcgtcatcttgatttttcacataactgaaagccaacctgtagaaatcttgcttatggtcagttatgcatgtgacaagcaacgcttttgttgtttgttttttcttcattgcaataaagggctcctttttgaatatacgtatatcgtaggctgttacctaggatagacgcggcaggctgaaaaatagtttgcgcagaatcacatttttttaaaagagagaagtaaatcagcatggggggtttatgcataaaaaaacaaggcttgttttgtacaagccttgttttggttaagcgatgcgaatattattccaaataatgttttttgaaatctgaatggatagaaaatttacggcgcaactggatgagatttttcccgaagctctcttctaaaagctctctatgctttttcagaatttccatgaggtacagatcatgaatgatcacttcagtaataggcatgactaaacctacatgcatcgtccatgcagcacggctgtcgttgccaagtgagacaatgcctgctacgacttctgaatcatctccgctatagacaagccaccgtccgtcatactcttctgtaatttcactgctcatatcatgaaggtaaacattggcaaaatcagatacgatgtctccgtacgcaataatggtgacaataacgccttgttctgccgcatgtttgatctctgattctatctcctcaaaatcctctttccatatttctaagaggattctttttttggcagataaaatacaagccttcaccttttcaagaatttcactgcggccggtgatattccagatgttttcccggtcatttgcggtctgctcgaacttttcaaaatatttctcagcctgatcaaaatgctcttccgctttgagtcggcggtttttaatcagttcttttgcggggactggaacatactgaggcgtatttccatgactgacaaaaacatctccccttatgacaaggctttccaagacttcataaattttagaacggggcactccggattttttggcaacggcatagcctgttaaaggtgattcttgcaataatgccaaatacgctttcgattcatattctgtaaaattgaggttttttaaaatgtctaacatattttctttcatatatcctccaatataaagagcaattactgcctttgtaatcgctattttaacaaaccatattgatttattccaaatgcattgatacacttttataagtagttacttttgtagtcactatatgattgaggggatttttaaagggggagagaacaatgcacagcttactcgcatacataccgatcgctgccatgatggttatcataccgggggcagatacgatgcttgtgatgaaaaatacgcttaggtatggcccgaaagccggccgttataacattctcggattggcaacaggactttccttttggacggtgattgccattttaggattatcagtggtgatcgcaaagtcagtgattcttttcacaacgatcaaatatttgggagcggcatacttaatttatttaggtgtaaaaagtttttttgcgaaaagtatgttttcgttagatgacatgcaatcccaagcaaaaaatatggcaagttctccgaaacgttattataaaacttcctttatgcagggatcactcagtaacattctcaatcctaaaactgttttggtgtatgttacaatcatgccccaatttatcaatttgaacggaaatataaaccagcagctcattattttagcttcaatcctaaccttattagcggtgttgtggtttctgtttcttgtttatattattgattacgcaaaaaaatggatgaaaaactcaaagttccagaaagtgtttcaaaaaattaccggaataatattagtaggtttcggcatcaaaactggtttgagttaacacttaaatgaaatttgaaaccaaagtttaatttagtgtttggccctataaaaaagacaagggagtgagtatcccttgtcttttttatttcaccttatgtcctctgcgggtttgcaccttgtacaaaataatcaataaaacaaaccagaccggagtgacaaacaaagcaatacgtgtatcatttgccagtgccaatatgacaagaatgaacgcgagaaatgcaagtgttaaatagttggataatgggtaaaaaggcattttaaatttgtttgctttcgcttcatgctgccttgtttttcgatatttcaaatggcaaatcaccgtgatgccccaaataaaaatgaagcatattgtagaaacacttgtaatcagtgtgaagacttgctcaggcattaaataattcagactaacgccaatcagaatggcgacggatgaaaagaacagcgcattgcttggcacgttagaagaagttaatttctttaatagtccaggtgcgtgatgatcctttgcaagtgaatagaccattcggcttgtgctgaataaagcgctatttgcagctgacgcggctgatgttaatacaacaaaattgatcaaactggcagccacaacgatgcctactgcagagaagacctgaacaaatgggctttcgtttggattcaacacattccaaggatagatacacataatcacgaaaagtgcgccaacataaaaaagtaaaatccggacagggatttgattgatggctttagggatcactttttggggattttctgtttcacctgctgtcagtccaaccagttcaatacccacgaaagcgaagacgaccatttggaacgataggataaacccatgccatccatttgggaacatgccgccgtggctccaaaggttggtgaggctggcagggccggaagctgcggaaaaacctttcgcaatcaggaaaataccagttacgatcagagccagtatggcaatgactttgatcaatgcaaaccaaaattctaattctccgaaaagtttaacggtggcaaggttcatgatcagcaggataataagcgcaagaagacccggcagccattgaggcacatcgggaagccaatattgcgtataaatgccgaccgccgttaaatcagccatcgcgagggaaatccaacagaaccagtaggtccacccagtgataaatgctgccatgtttcctaaatagtcccttacaaaatcaacaaaagagtggtatcccgcatttgataagagcagttctccgagcgaacgcataatgaaaaagcaaaatacgccggtgatcaagtaagcaaataaaatggatggtcctgcaaaatggatggatttacctgaacctaaaaataaacctgtaccgattgcacctccaatcgccattaattgtatatgcctgtttttaaggcctctagacaatttctgttgctggccaaaattgtctttgctagaattgcctatcaattttattttcctccagtaataaaaagatgagtaaagttttatcggatattataacatttaaaaggatagatacttttatttttaaattttaaaactattttaagtgctgttacatgtcttctggctctatttttcactcgtgattctacctgaatagcagagtaaaacaggaaaatcatttggacaatctgacaggctagttttaatcggtaacgatttgtataattgcatacccactatgtttgagacctgcaagggggatcaaatcgagagaatcggagataaagtttttaagcttacagatttcttaaccttcaaagtggattgcaaaaatgacgaagttttgcaaattgtaatactgtggcggtcacatagagtgtccgtctttttagttgtgaacgaacttaaggggttatatttgggtaatttgtcatgatctataagattcattttttgtcattgatgattttgacatcattacattccccgagaatgataaactgtttactgattattacttttgaaggggactggccctccagaactgagcatctatcatactaatatgagatgcaaatgattcaaaatgtaaacatatacgcataaaagccagttttgtcaatctgctatagagacctttttaaacgtgtatcagcagataatctcaacgcggactataaagtttcgaaatattcttgttaatggcttatctaataaggacaaaggatgatagacgtgagaagaatagataaaatataccatcagctcaagcataattttcatgattcaaccttagatcatcttttaaaaatacaagggaattcagcaaaggagattgccgagcagctgaaaatggagcggtccaatgtcagctttgaattgaacaatctcgtccggtccaaaaaggtcatcaaaattaaaacgtttcctgtaagatacatcccagtcgagatagcagaaaaattattcaacaagaaatgggatacagagatgatggaagtgaaagaccttcaggcgttttccggaaattcaaagcaaaatcatcaacacatttccacgaatcctctagagcttatgataggggcaaaagggagtttgaagaaagcgatctcccaggcaaaagcagctgtcttttatccgccgaccggtctgcatatgctcctcctagggccgactggttccggtaaatccctttttgcgtaccgaatttaccagtttgccatttactctgacatattgaaggccggcgcaccatttattacatttaactgtgcagactactacaacaaccctcaattattgctttctcaattattcggacacaaaaaaggttcatttacaggtgctgccgaggataaggcgggtttagtcgaacaggccaatgggggcattctttttatggatgaaatccaccgtctccctcccgagggacaagaaatgctgttttattttattgacagcggttcttataacaggcttggagaatctgaacataaacgaacatcgaacgtattgtttatttgtgcgactacagaaaatccgagttctgcactattgaaaacgtttttgcgaagaatcccaatgaccattcatattccttcgcttgaagaacgatcgcttaaagaaagagtggatctgacgacgtttttattagggaaagaagcagagcgaattaagaagaatctgagtgtgcatatcgatgtctataatgcgcttattcactctgcgaaatttgggaatgtcggacagctgaaatcaaatgtccagttagtttgcgcacacggatttttgcataaccttgacagaaatgaagttattgaactgactgttcgcgatctgcctgatgaaatcaagcaagaatggatgtccagcagcaaaaacatgcaaagaagcaaagccatttctgaatatgtcaatattacaacgattatctctccgattgtagaagatgaaacaacaaaaattgacgaagacctctcatttaacttatatcatttgattgaggaaaaagtgaaaacgcttatgaaagaaggtttatccaaaaaggatattaaccagtacatcttgactgatgtccatttgcatgtcagaagtttttttcatcatcaagcttttcaaaaagacagcctgctgacattcgttgaagatgacgtgattcaaatgacaaaacagttaaaagaaatagctgaacatgagctggattgcacatttgaccgtaagtttatttatttcttgagtatgcatattgacgcatttttaaagcgaggaaagcaaattgatgttttgaatacacaggagacggatgaaattcgtgatacccatgtgaaagaatatcgggtggcgatgatttttaaagataaaattcaggaatattttaaagtggctattcctgaaatagaagtcatctacttaacgatgttaatccattccatcaaatcgttaaaggagaacaaaagagtcggtatcatcgtggctgcgcatggaaacagcacggcgagttcgatggttgaagtcgcgacagaactgctagggagcacgccgattgcagcagtcgatatgccgctttctgtttcaccttcggacattcttgaatgcgtagcagaaaaaatgaaacaggttgatgaaggtgaaggtgttttaatgctggtagacatggggtcgcttgcaatgctggaaagcaggctggaggaaaagacaggaatttccattaaaacgatcagcaatgttacgacttcaatggtgctggatgctgtcagaaaggtcaactatttgaatttaaatttgcatgcgatctatcaatcggtcacgaaggattttatcgagttgtgggagcgtcagccagcggcacccggcaaaaagaaggcattggtatccatctgcaccacgggcagcgggacggcgaaaaagctggaagacattctaaccacgatcgtaaacaaggcctccgatacaccgattcacatattgaccgtatcatcgattaagctggccaacagcataaaagaaatcgaaaaagagtatgaaatccttgcgacagtcggaacgaaagaccctaaaatcaatgctccgcatgtatctttagaagtgttaattgaaggggagggagagaagctgattcaacaggcgattacaaaaggaagcatccccttgagcaatggattgaacgaagcaaatatgattgtcagggagctttgcgaggatagcctgaaaaaataccttgttttcttgaatccccatcatgtgatcgaaatgttattggagtggctgcaaaccgttcaagatgagctgggggtcattttcaataatgcggttttgatcaaagtcattatgcacacggctttcgcctttgaaagggtaattaagcaaaatccgatcgctttctcagaggaagaagagatcaatgatcagctgaaggaaatggtgtacgtgacagagcgaacattagccccttatgaagaaaagctcggacttcgcataagtgatgatgaaaaattatttatagccgccatatttgctgaagaagtgcatggccagctgttttaaaaacagttttttcatatgaacctgtattaaatggaacaccattttaatacaggtttatttttttcgttttaagtgtttcaacaacaaattgctattggctgaaataacaatgaaaacgcttaacacaactgtgttggcacgatccttgcattatatatggatgtacaaaacaggaaaggagcaatagacatgatttcagttattatcagcggtcatggagattttcccatagcattaaaagagtcttcagggatgatattcggtgaagaaaataacctgattgcagtgccgttttttaaaggggaaggaatacaaacgctgcaagaaaaatatcatcaggcgctcaaggatatcccggaagaacatgaagtgctttttttagtcgatatttttggagggacgccatataacgcggcagcttcctttattgctgaggatcaaagaatggatatggcagccggcgtaaacctgccgattctgctggaggtattaagcctgagagaacatctggctctcaaagatttgctgaacaacttaaaagcaatgagtcagcaaagctttcaagtgtgcagtgaacatttagaaaaagtaaaaacagccaatcaagatacaagagaggatgaattatgatgaacattgtgttagcaagaattgatgaccgctttattcacggccaaatcctgacaaggtggataaaagtccatgcagccgaccgaatcatcgttgtctccgacgatattgctcaggacgaaatgagaaaaacgctgatcctttctgttgctccttcaaatgtaaaggcgagtgccgtctcggtttctaaaatggcaaaagcatttcatagtccgcgctacgaaggggtaacggcaatgctcttgtttgaaaatccgtccgatattgtatctcttatagaagcaggtgtaccgatcaaaaccgtaaacgtcgggggaatgcgttttgaaaatcatcgcaggcaaatcacaaaatcagtcagtgtcacagaacaagatataaaggcatttgaaacattaagtgacaagggcgtgaaactggaattgaggcagctgccttcagatgccagtgaggattttgtacagattttacggaacgtaacaaaataatcaaggggatgagaatatgtcttcattacaaattattttgttgttaatcattgcagcaatcaccggaatcgcaagtgtattggatgaagggcagacacaccggccgctagtggcctgtacgttagttggcttggtgctcggggacttaaaaacgggaattattcttggaggcacactggagctgatggcgctcggctggatgaacgtcgggcttgccatggcacctgatacagcgatcgcctctgtcatctcaaccattttagttattaccgctgatcagggaattggcgaagggattgctgttgctgttgctttagcagctgcgggtcaggcgctgacgatttttgttcggacgatcactgtctttttcatccaccgcgctgatcaatatgcaaaagcgggaaatataaaaggaattgaaattatgcatattaccgcgatggtgtttcaagctttgcgcgtcatgattcctacattgattgttgctttaattagtgtcagcgctgttcaggcgttcctgggaaatattcctgatgtcattacaaaaggactgcaaataggcggaggcattattgtggttgtcgggtatgccatggtgatcaatatgatgaatattccttatttaaagccatttttctatattggtttcttattagcggcgtttaccgattttaacttagtgggatttggagcccttggtctctgtctggcgcttttataccagcaggtgatgcaaaaacaaagcgctcacagagcagtcgcggccgcatcagacagtggcagtgttgctgtttatgatgacgatgatgatcttgatgcctaaacgatgaggggggaagaaaaaatggagaaagaaaaacgattaacgaaaaaagaaattttcagcatgtttattcgttcaaattttttactcggttcctttaacttcgaacgtgtgcaggcaatgggatattgttatgtcatgataccggcgatcaaaaaattgtacggtcccggagcgaaaagaaacgaagccttgcagcggcatttggaatggtttaatacacatccgtggctgacagcgcctatatttggcgtgacggcagccatggaagaagaaatggcgaacaataaaggaattgacggaaaagcgataagcggaatgaaaattggtttgatgggaccaatagcgggcgtaggcgatccaattttctggggaacgattcgtcctgtcttagctgcgctaggagcctcccttgctttaggaggaaacattgccggccctttgctattctttttcttgctgaatgccataagattaagcacaaaatattatggattaaagtatggctatgtgaaaggaatggagattcttcaggatttagcggggaatcgcattcaaaagcttacagagggcgcttcgattctcgggttatttgttatgggggctctcgtgtccaaatggaccaccatcaacattccaatcgttgtatccaggattaaggatgaaagcggaaaagtagatgttcaaacggtacaaaacgtgctagacagcattatgccgggggcgctgcctctcggattaacgttattggtggcatggatgcttcgcaaaggggtgaatccacttctcattatttgcggcatctttgtcatcgggattctcgggtattgggctggattcttagcataaggtgtgtgaaggaaagagagagaacctgcagcagttttttcatatataaatcattcggataacagtgaaacagagaagaattgccagaaacggaccagcttgcgcagcagtctctcttgaaagtgttcaaacatgaagagaggagcgaaggaacaaatgaaaaagagacttattcaagtcatgatcatgttcaccctgctgttgactatggcattttcggcagatgcagccgattcaagctactatgatgaggattaccgtcctcaatatcacttcacaccggaggcaaactggatgaatgacccaaacggaatggtatattatgctggggaatatcacttgttctatcaataccatccatacgggcttcagtgggggcccatgcattgggggcatgccgtcagcaaagatttggttacatgggaacaccttcctgttgcgctgtatccggatgaaaaaggcacgatcttttctggaagcgcagttgtagataaaaataacacaagcggttttcaaacaggcaaagagaagccgcttgtggccatttatacacaggatcgggaaggccatcaagtgcaaagtattgcctatagcaacgacaaaggaagaacatggacgaaatacgctggcaaccctgtcattccaaacccgggtaaaaaagattttcgcgatccaaaagtcttttggtatgagaaagaaaaaaagtgggtaatggtgcttgcagccggtgaccgaatcctcatttatacatcaaaaaatctgaagcagtggacgtatgcaagtgaatttggacaggatcaaggaagccacgggggagtatgggaatgcccggatttatttgagcttccggtagacggcaatccgaatcaaaagaaatgggtcatgcaggtcagtgtcggaaacggagcgatctcgggaggatcaggcatgcaatattttgtaggggactttgatggaactcattttaaaaatgaaaacccgtcaaacaaagttctctggacggattacggcagagacttttatgcggctgtatcctggtctgatattccagccacagacagccgccggctatggttagggtggatgagcaattggcaatatgcgaatgatgttccgacatccccatggagaagtgcaacgtccattccaagagagttaaaattgaaagcgtttaccgaaggggttagagtggtccaaacaccagtgaaagagctggaaaccattcgcggaacctctaagaagtggaagaatctgaccatatcgcctgcaagtcataatgtgttaacggggcaatctggagatgcctatgaaataaatgcagaatttaaagtaagccctggttcagctgctgaatttggttttaaggtccgaacaggtgaaaatcaatttacgaaggtcggctatgaccgaagaaacgccaaattgttcgttgaccggagcgagtcgggcaacaacaactttaatccggcctttaacaccggaaaagaaacagccccgttgaagccggtaaatgggaaggttaagttgcgcatttttgttgaccgctcctcggttgaagtatttgggaatgacggaaagcaggtcataacggatattattctcccagaccgatcaagcaaagggcttgaattatatgctgcaaatggcggtgtaaaggtaaaatctttaacgatacaccctttaaaaaaggtatggggaacgtcaccttttatgtccaatatgactggctggacgactgtaaatggcacgtgggcagacacaattgaggggaaacaagggaggtcggacggagattcctttatcttgtcttcagcatccgggtcagacttcacttatgaatctgatatcaccattaaggatggaaacggaagaggggcaggagcactaatgtttcgctctgacaaagatgccaaaaacggttaccttgccaatgtggatgcgaagcatgacctagtgaaattctttaaatttgagaacggtgctgcttctgtcattgctgaatacaaaacaccgatagacgttaataaaaagtatcatctgaaaacagaggccgagggcgatcgctttaaaatctatttagatgatcgtcttgtgattgatgcaaatgattccgcattttcagaaggccaatttggcttgaatgtgtgggacgcgactgctgtctttcagaatgtaaagaaggagtcttaattttaaaaaaggcacagacccgaacagtctgtgccttcttgttattttaacaagtttaaagattcgcggttaaatgcttccaaatcatcaggtgttctgcttgtgacaatgttgtggctgacgactacttctgcatctttgtagtttgcaccggcattgattaaatctttgcggatgctgcggtagcctgtgatatctttgccttttagaagatccgtatcaatcagtacttgcgggccgtggcaaattgcgaaaacaggttttttgttttcgacaaatgcttttgcgaattcacccggacggtcatctgcacgaagcaaatccggagagaatcccccaggaattaaaagtgcatcaaagtcacttgcattcacatcagagatggctttgtcaatctttactttctcgccatgcttaccggtaacttctttgccggcttccaaatcgatagccacaacactgtagccagcttcttcgtatgcttttaccggacttgtatattcgatgtcttcgaattggtctgtaacaagaactgcaatttttttgctcataaaaaaccctcctaataactctctattcatagaataacaggaagattgaccggccttcaaaatatttgcttaaagagatcatttttcgtgagtttcaataaaagcggcagcccatataaggactaacctattacaatgtggaaatatcaatcacaaatcgataacggacatcgcttcggaggatacgtccgtatgcctcgtccacttggtcagctccgatgacttcgattttaggttcgatgccatgctcagctgcgaaatccagcatctcttgagtttcttgaattccgccgactagagaacctgcaatgctgcggcgccccatgattagggaaaacacactgtatgtgtccggcttggcaggagctccaacgtttacaagtgtcccgtctatacgaagcattgataaataggcatctacatcgagatttgccgataccgtatttaagatcacgtcaaaacgcccggccaatgcagtgaatgtggctgggtcacttgttgcaaagtaatgatttgcaccgagttccagagcttcctctttcttattcatggaacggctcaggacggttacttctgcacccatcgcatgtgcaaattgaattgccaaatgtccaaggccacctacgcctacaatcgcaacctttttaccagggccaacattccagtgtttcagcggggaatacgttgtgatacctgcacacaacagcggactggcaacatccatttccaaacgatctggtatgcgaacaacaaatctgtcagtgacaacgattttttggctgtacccgccataagtggggtttccgtcgtagtctactgagttatacgtttgaacaacacccttcgtgcagaattgttcctctccgttgagacagtattcgcattctccgcaagagtcaacaaaacagccgacaccaacgcggtccccgacagccaacttggtgacttttgttccaacagctgttacaacaccggctatttcatgtccaggcaccattgggaagatgccaccgccccattcatcaaaagcgctatgaatgtctgaatggcaaatgccgctgaatttaatatcgattaagacatcgtgcggccgtaatcctcttcgctcaatcgtcgtttgttcaaatttggcttttgcatgtgacacgcttaatacacgggtttgatgttgattacacatatgaaccttccctttcttcatcataagtgttgtaaaaaaacatgcacttatttatgttttatggtgtcttcaacataacgataaaccttaaagtctgctttaaggcaagggtttttttaaaataacatttaaaatgaacctgatttataagctgagatacagtcagcaattaacgtagaaactgtaattatgctgcgatctcggggggaagttcttcctctctttcccaaatgtcaccgaatagaacatcatcatgaagttaagcaaactttggtttgttctcttccggcagtttgtttatttgccattcagcaatccctccatctacactgtttttattgcatggagaagtatagagcttaaagtgtgctttaaggcaagtcccgaatatataaacccagattcagcagctaaccacttgtcttgagcttgacttaaagttaactttaagtgttaccttcacaacatgcaggatagagaggtgaagatcatgaatattgctcaggtggcaaagcagtttggcctgacagccgcaacactcagatattacgaacgtgtaggattaatcccgcctgtaaaacgaaaagacagcggcattcgcgactatgatgaagaagatatcaaatggattgaattcattaaatgcatgcgaaatgcgggactatcgatagaagcgctaattgaatataaaacattatttaccgaaggtgaccgtacggtagaagctcgaaaaaatatcctggctgacgaacgacagcggctgatagagaagcggaaagaaattgatgaaacaattaagagattagacacaaaaattaaagattatgatgggaaattgcgtgaaaatgaggcaaagctcaaaagcaggcctaaaacggaaagtcttcacggatcagtggagcaaagaaggtagcattctttgcgtgtgaagagggcaggtcaaagttttctccatcaagaaatcgcataaaaagaggtggttacgattccttatttggattggagaatttgcaaacattatcggagatcagatggagaaaagcggttaatctatttacggtcataggacccgaacaaacagtgctcattttgaagctgaggaacagttgtggccaatcaatactgttcctcagcaaatcagtcattgtatgttaaagggttggcaattgaatggctgtatcaatattttttaaattcagcttgacttgttcgtcagggttccaaggatggtaccagcctttttccatcatatagcttgagagttgttcgtgcatatcgagtgcttcttccaaatggcggataaggacctcttttacttcaggtgttccggcttcagtggctgccatcgcataatttctgactccgttctttgctgaaattaataagtccatagcaatgatttggtctgttagaacattcatgccagtcagatattctatgataggattcatgatttattcatctcctcattcgtgctttgcattagataaaatagaggcaaattcctgcaactggcgtgtggtgatatcaacatcttgctgcatgatttctttcagcttcggatcagataccagtgctttcattgttttagatttcgtcaaacaaagtgtcttaaatgcagtcatttcctgaacctcaagcacttcgtgtaaggcgtattccatttctgtaacctccgtttttaaggctttaacacaactttgatacaatcatccatttttgaatcaaaaatgtcatagccatgcttggcttcactaagcggcaggacatggctgacaacatctcccggatcaattttgcctgtcgatactagttcaaacatgtacggcatatagtggatcactggagcctgtccagagcgtatattgacgtttcgctgcataatatctcctaacggaaaaccgttatatctgcctccatacacacctgtaatttgtatggttcctcctttgcgaacagcttgagaggcaatgaccaatgcactcattgttccgccatgaagctttaatccgctggcaaggaactcgagatcgctcattttaccatccatcccaacagcgtcaatgactacatccgctccgcctttcgtgatttcctttaaataatttcctgtattctcatggtcttcaaaattaacgatttctactttgtttgtacgtttcgcatgctgtaagcgatagtttacatagtcaactgctatgacgcgttttgcgccttttagccaacaaaacttttgagcaaacaggccgactggtccgcagccgagaacgataactgtatcgcctttttttacgccggcattgtccacactccaaaagccggtggtcatggcatcggcaatcacgcttaatttctcatcgggttcctcacaagattcagggattttaaaatgggtaaaattcgcaaacggcactcttaaatattcagcttgcccgcctggataaccgccagtttgccctgaatagccgaaataagcacccatttccccattgtcattagactgatcacattggctttccagctggtttttacaaaaaaagcattccccgcatgctatattaaagggaataattacccgatctcccttttttagtttagtcaccccagaaccaacttcttcgacgattcccatcggttcatggccgatgacatagtcttcttgcatattcggaatgaatccatggattaaatgtaaatctgatccgcaaatggctgtactggtgactttgataatcatgtcatcggatttttcaatctttggatcggggacatctttgacaacaacatttttaatgccttgatacgttactgccttcatgctgtaaaacctccagtgttagtgttcatcaggtgtccggtcaaacatccctttaccatttgtttcatcagggaagaggttcatattgccgaccatgatcgtgttttttgcagagagctgatccagcttatactgttcgctcagctcatatggatggaaccattttttgctgatcatcagttccgtaatctcttggtgcattgcaattccttgcatcagctgtttccgcagcaaggctcttacatctggtgaagcggtttctgtcaaagctacagcagtattccttacgccttccttagctcgtataagaaaatccatcgcgaatgtagtgtctgctagttcaggcacattcagcgaattaatggggtctaaatgatcattattcaaagaggcttaccttcctttcaattgatgattggcgttgggcggctttgagggacaggggcctgaaatgaggcacgctcataaaccgcttgtaattcagtaaggtcttgaatggattgctgtacatctttttgcatcaagtccttcagttcttggtcaaacacaagtccttgcattaactttgatttcgctatacaaagtgttttaaagttcacgatttcatgtaagtcaacagcctcgtgagctgccaatgtttgatgatccatattgatgtaacctcctttatcaacgttacatttcccgaaatgaagttgaagcatacagaaaatacactcggtatcattttttgttttaagaatcgctgtttttgctcgttagcgtacatttcttatgacatggaataaactgcacttaaatctgaaataaaggtgaagtaggaaatttatttatggaaacttgacatagtgctgtcaggtttccttttgtatcattaaattggatgaccagtaaaaagtatggttttataggaggcactcgatatgaagctgttacaaattagactgttggtgaatgattttaagaaaagcgtggagttttacaaagattcattaggacttccaataagttggttagagaatgaaatggaatatgcactctttgataatggggaaacgaaaatagagcttttatctcgtgaaacgatggctgaaatcgttggagaggaaaaaaaatcgttggaaggagaagctcaatcaaaatttttgcttcagtttaaggtagaagatgttgataaaacatatgacgatttacacgaaaaaggagttaaatgtgtaaataaaccgcatgatcgcaaggaatggagtgcccgagttgctcacttcagagatccagatcataatctgattgaaatatataaaatgttatgatttttcgactcgcaaaatcatagaatataacgtttgataacgtacctaatcatttttatacgccctggtaaaagaaagcaaagtcataataggttgcggacactgaacttgcagcatttacgctgatttgtttggtgtccgtttttgattggtgaaaaaggtggagtatctatgaatcgagaagaagcgtggatacaaggcagaagtacactgattgagttaattggtggacacgaaaccgcttgatccatgtcctttttcctgattgtcaatcgtgattaccgactggacaaatgccaaatgtaacacaccatcaatatcaagcctgactaccatttattttgtatccttaattgtcgaaaacataggaataattccacttttgaaagatctagtttatggtacattgataaatatatgggaggggagggggcatggtatctgaaagtaaatccttaactggatgtaagaaagtcaaacgtacggcatttataaggggagggtataaggtgaataagctaaagaggctaagtatgctaacggtgatgattgcatctgtgttcattttttctagccatgcacttgcagctcagtattatacggtttcaacaagcagcggtgctcctgtcaatatgcgcagcggcccaggtacaagttggggaattgtaacgactattccgagcggaacccgcatcccgatctattgctacaaaaccggtacaactgtaactggaaagtatggaacgagtaatatttggaattacacagagcggacgcttgccagcggggagatcgttcctggatttgtctctgatacatatatgtatacaggctcagacggtccggttgttcctaaatgcagctggtagcatatgttctatcgtttcttaaaatgaaggaattgaagaaagagggatgacattgactaaactgaaaatgctgagtatgttaaccgtgatgattgcatctttattcattttttccagtcaggcacttgccgtgcagtactttactgtctcaacaagcagcggtgcgcctgtcaatatgcgcagcggtcctggtacaaattatcctattatgctttccattccgagtggctcccgtgttccttattattgttacgcttatggaacgactgttacagggaagtatggaacgagtaatatctgggaccaaatccagtggaaagattcccggggtgtcgtgaatattggatatgtgtctgacacatatgtgtacacaggttcagacggccctgtcggttacaaatgcaattagctaaatactccgtacaatagaatctcttcttaagggcctatctaggacgaaccataccaacaacaatagttggtatggtttttgctgcgatgaagtcttccatacctgcatttgtggtgattttcaaaagagattcatgatgttagacactggttgttgttgaggacaaaataacgagccgctttagagttgtatctaatggtataaaatacggaattaagataggaaataatcaataggagaacgtaatgtacaaacctatttttcgatgaaatccctaatatcactttggttaaacatctcacattgcgttctcgttagtgaaaagttctttttacgcttcgtgaaatcttctccaattccatagttagttttacctgtcctattttgaacacgtatgtttattttctttttctaacatgtcgtgtaacctctcagaaaattctttatggtacattgtgtaccccgtatgatttccggggaattcaacaaattctgtttccaattgttccgctagggcgttcgcgcaacgataaggaaaaagctcccgagaagcacttccgccagctgggagtatcttcatcggtgaagatgtaaacacagtttttaatgcttcgaaatctaatgtatagctgagaattccttgaatttcatactcagtgaaatacgttgaattgccgagaagccgctttgtcagcacagcctttgattgttcgtctgtctctaatcttgacatgaacttaatgacttcacttcgatgatttttcttaaggtctttcatgaattgctcggcttgtttcagctcatttccatgcagaagctgcaataagattggttcgtgtgggatcatgacatgtacttgttcgggatggcgtatgcacagatcaagcccgataacagccccggagctacttccaaatacgtatgccggtttattggtgattttggctagaagacggtgagcatcgtcactgtgtgtttccacacggtaatcctcaatctgattggcgagattgctgcgggaatggccgcggcgatcgtaagtaacaaccgagtaccagttagccagatgattggcaacatgatggaacttgtcggtatcaccgcctccgccgtggaccaaaagaatgattggacctgagccacgcacctgatagtggatgttcgcgccgggtacttgcaacgttccattgtttatcgtcatttgtaggaccttcctttcttctcatctcccttaactttacacaattggccaatggtatcatatgcaggaaataactaagaaacaaactcgccatataaaaagcactgatgatttttcatcagtgcttccgttttgtttatttagagtagacaattttttttattgtttcatcagagaggtgatattcatcagataattgatgaatggttttgccgtttttaaatgcttttttaatagaagcgtttctatcatcgatcagctttcttgttcctgaacacgcaccccatttttgatgagaggattcaggtttagggatatatattgtttttccttgaacatacttttgaatttccgatatcagcttttcaggtaaaatagcggtagcttttacatatgccatttctgccagctccttatttttttatgtcaaataaggtgcaaagcaactatatcagaaaagcttactggggcgatcttttagaaagtctaccccatgcaaagtatcgccttcccaataataggctttgcatgggacgttgcggaatctggcattctcatcttgcttgccatttacatcacctccctaacgattttcgatgatcatctccattataaaatagagtaaagccttatggcatcttgttaattaaagttggcagtaagaaagggaccttcccagtgagaggggctaaggctgattggcaatcaaaagagtaagattcaagctatattactttagattcaaaatattgacaaattgatgtattttcaacaatagggcagtttcttcatgtatactgagtctgtatttacaatttttagaaaggggaagtaaaatgaaaatcagtatgcaaaaagcagatttttggaaaaaagcagcgatctcattacttgttttcaccatgttttttaccctgatgatgagcgaaacggtttttgcggcgggattgaataaagatcaaaagcgccgggcggaacagctgacaagtatctttgaaaacggcacaacggagatccaatatggatatgtagagcgattggatgacgggcgaggctatacatgcggacgggcaggctttacaacggctaccggggatgcattggaagtagtggaagtatacacaaaggcagttccgaataacaaactgaaaaagtatctgcctgaattgcgccgtctggccaaggaagaaagcgatgatacaagcaatctcaagggattcgcttctgcctggaagtcgcttgcaaatgataaggaatttcgcgccgctcaagacaaagtaaatgaccatttgtattatcagcctgccatgaaacgatcggataatgccggactaaaaacagcattggctagagctgtgatgtacgatacggttattcagcatggcgatggtgatgaccctgactctttttatgccttgattaaacgtacgaacaaaaaagcgggcggatcacctaaagacggaatagacgagaagaagtggttaaataaattcttggacgtacgctatgacgatctgatgaatccggccaatcatgacacccgtgacgaatggagagaatcagttgcccgtgtggacgtgcttcgctctatcgccaaggagaacaactataatctaaacggaccgattcatgttcgttcaaacgagtacggtaattttgtaatcaaataagcagtgaggaaaagaaaccgctgcagatgaactcaatctaaaagataccaatgatgttggtatctttttatttgcagtaaaaagtattcaattttctctataatgattatgtcatgcttgaggcagatacatgaaaggaccttggcgatttcataaaaaacaatatagaggctttcctaaagccatgcaagattacaatggatctgtgcaagaaggcgcattcaatccatctattaacgatggaaagggggaggctttttgcacagtccatctacatcatttgatagtctccatgcgtataaactgttccgtccataatacgtcgtgcggtacggacgatctttataccagtgggctccaccattgtttcaataataccagaagaatgagctagccgaacctttgtagagtggttttttgctattcttgcagggattgcaccttccactgaaagggctcttgttgtacatatcgctccagtgacagccagtgcttgatgtggcttttgcatggacatcatcctgatgtgtaagtccatctcaacgcttgaatgccaagcacctgtactatctttatatttctctggttttgctactatagccagtttggggacagccggcgataactttgtagctgaaaatcgactggcaaagccgcatttctctgccgcaatggatcttaattcttcaaattgagccaactgtagatcagtaaattcttctgcaagttccgttccatccaggccgatactgctcgcttccacaaaaactaatggatttgcatagtcgataatagacacctctatttggccttgacttgtatctaaaaactccgaactatttccagtaggcaataaatgaccggtaactgaaccagcggcatcatgaaagtttaaatagattggagatccagatccaggtactccagatatcgtaacatctccgtcatatttgacctgaccgtcttccacttctacttccgcaatgatcattttattcgtattggtattcaggatccttaccgcagtcattggttctgtcgcttttacaagtccttcttcgatagcaaatggaccaacagcagcggagatatttccgcagttccccttaaagtccactttttcttctgaaatgctgacttgaccgaaagtatagtgaacatcaatatccgaagtatatgctttctttattattgccactttactagtaagggaattaccgccacccaaaccatctatttgtcttttatcaggacttcccatgacatcaagcaaaaagggctcccattcgtttttattgttaggcatggctgattcgtggaaaaaaacgcctttgcttgttccgcctctcatgattgttacattcgtcttgaccatcgtcatcatcctcatcttaaaggtagtattttttatgttttttagtgtagaaggtaaaaaaataaaaataaaatataagttttcttaatattcgataaaaaaacttttataattgtgaaagaaggactagaaaggaagatgaaaatggatgagaaagattggattttattgaaaattcttcacgaagaacaaagtgtaacaaaaacagcagaacgattatttacatcacagccttccatcacttatcggttgaataagattgaggagattttcggaattgaattattcaccaaaaggcataaaggaattacctttactgcggaaggagaacacttggttgcttatgcaagaagaatgctacaggaacttcaagataccaaagatcatatctctaatctaagcaaagaggtgcaaggacatctaaggctgggggtatcaagcaatttcgctcaatataagctccctaagttattaagggaattttccactatgtatcctaatgtccaatatagtgtacaaacaggctggagcacagatgtcatgaaattattagatgctggtattgtacaagtcggtatactgagaggaagccatcgctggaaaggggtggaggaacggctgacacgggaaaaattacatatcatctcaaaaaaaccaataacgatagagcaacttccttttttaccttttatcaaatataaaacggatgcttctttaaaaacgattatagaagattggatgcatacgaatctaaaacaagcccccattattgcaatggaagtggatcgacaagagacttgcaaagagatggtaaagcatggtcttggttactccatagcaccagaaatttgcctgcaggaatctgatcatttgtacacaatggaactgtataatgctaagggtaagcctctaatgagagatacttggctaatgtacgatcaaaaatcattaggaatcaaactcgttaaagcattcattgattttttaaagggtgaacaaatggtaaccatttaaagttatgatagaattttttttgaaacacagtaaaaaaatatttatttaacttattacaccgtataagatatgttaatcaaaagtcatttgaaagcgcattcttggaggtgtaatatgcttactattttaggtttttcgatggtaactgtttttacaatattaataatgacaaagaaagtctcgcctattgttgccttgaccatcactcccattgtttttgctcttattggaggttttggtaagggtattggcgacatgattttagaaggaattcaaacagttgcaagttcagcggcattgctattgtttgctattctttttttcggaattttaattgatgcaggtttatttgatccgctaatagaaaaaattttatctatagtaaagggagaccctgtgaaaatagcgatagggtctgccgtcttggcaatgcttatcgctttagatggggacggtacaacaacctatatgataacagtctcagcaatgttacctttgtataaaagaattggtatgaatcccatggttatggcgacattagcaatgctgtcgttgagtatcgttagcggaatgactccatggggcggaccagctacaagagcgatttcagtgctgggtttggatccttcagatttttttgtaccattacttccgaccatgcttggaggtattgcttgtgtgatatttctggcttttctaatgggaaggaaagagaggaatcgaataggcatcgttcaattagagcctagacatataacaaaggacagctctcaatcttatatggctgctactttggagagcgaacaattgaaaaggccacgcttaatatatcttaatttattcctcgttataagtatcatggtgtttattgtgcttggaactaagcatccgtcagttttatttttaattggttttgttcttgcccttactataaattatccgaatgtaaaaatgcagaaggagcgaatcgccgagcattctggtaatgccataaccgtggtattattggtattttcagcaggagtatttgctggtatattatccgggacaaagatggtggatgccatagcaggatcattaatatccatcatcccctcatcaatgggagggtttttccccgttattgtagcactcactagtattccgtttacttttgttttatcaaatgatgcatattactttggtatggtacctatctttgcagaagctgcctcagcatatggtatagaaccagtagaaattgcaagggcttctataatggggcagccggttcatctgatgagtccattggttgcgtcaacagtattgctagtaagcatgcttaaaatggacttggggtcatttcaaaggtttgccgttaagtgggctgtaattacatcattagttattacgttgttagcaatcattacaggggctattactattttgtaaagaaacaataataatatttagactgccaatgaatcattagtttgattgatttaaatacagctgaaaggggtcccaagctgatcaagccagttgtctttccagttactctattgtttagggttcttttttagaagcggcagcatttttgtcgatgtttagccagcatttcagcacgatgtggaaaagacaagagacaaacatgctcttgtctttcttaatatgatagttcagtataaatatttaagaaaaatgtcagtattgagtaatgaatgtatcaccaggcgtatgcctcaggtgtctctcctccaggtccgggaaagatatcatttaacatgcagagaatctccttatccagactgatttcaacggcttttatcgtatcacgcagctgctcaaccgttcgtggtccgatgatcggcgcagttaaaactggatttaccagcacccatgccaaagccacatttgcttctttttctcctagttctttgcataaatctgaaaatttctcgagttgcaaacgatgtttttcaactaaatctgctctttttgctgtacgagttccggcattgcttttcaatgccttcccgccaagaagccctcctgcaaggggactccacgccactactcctaaaccaagatcccgtgcagccggcagcacttccatttcagctgttcgttctaataaactatacttatgctgttcagtgacgagtcccatgaatcgccgtttttcagcttcagcttgcgctttaactaaatgccagcctgcaaaattactggatccaatatagtctactttgccggagcgaacctgagtctcaaaagcttcccatatctcatcccacggtgtccgcctatcgatatgatgcatttggtacaattcgatatgatctgtctgaagccgcttcagtgatccttccagatgacgtctgattttgtatagagacaagcccctcatatcatttggtccgtcattcggatcagaaatcggttcatatacttttgtcgccagaacaactttctcgcggcgctgtcctccttgtgcaaaccattttccaatgatgctctctgtcaatcctgcgtttttgccccagccgtaaatattggcagtatcaaaaaattgaatgccgttatcaagcgcttcatccatgatacggaacgcagtcttttcgtctgtatcaactccaaaattcatcgtgcctaaacataaacggctcacccgcaatcctgttctccctaaataggtatactccacaacaaacctctcctttatcattatttttggcaacagctgcaatacaattgattcaacaattgtttcgctctttgttacgattaaaaagacgaagcaaatgtaaagcagacgcaaaattataggaggttctttcaaatgaatatagaggatctatgggatcaatttcatcagccgttaaaaacatatatttcacatagggttaacgatcaatctatcgttgatgacctcttgcaaatcgtatttatgaaaatacaagtgcatctcccaaatctgatcgatgaacaaaagatcgacagctggatttatcggatcactagaaatacgattattgatttttaccgtacaaaaaaaacaagcgaaatattgcctgatgttctacattttaatgacagtgcagaggaagaaaatttcaccaaggaagcagctgtgtgtattcgatcgaccatcaaacggttgcctgaaaagtatcgagaggcgctcgagttaactgaattccaggggttatcacaaaaagagttgagtgaaaagctcggcatttcttactccggagcaaaatcaagggtacaacgcggacggggaaaattaaaacagctgcttgaggggtgctgtcatattgaagcggatcgatatggaaatatcgtagactttcgtattttaaaggaataactgatgaacatagtcagttattcctttaaaataggccatccgcatgaagagcattttccctttgatgtttgcaaaagatgtatgtattatataaatcgtaacgttttcgatttgataaaaaaggagtgttggaatgaacattttattttcaaagccgctaggcatattaacgattggttcattactagttttggcaggatgtcagacttccggttcttctgcaggtgagtctaataaaacaacatcatcctcctcagcatttgaagaagactcttccaaaacgcaagagcaaacatctgacaggcacgaacattctcacgatcatagtcatgcgcatgatgaagcaacagaaaaaatatatgaaggctattttaaaaacagccaagtaaaggatcgcttactttctgattgggaaggagattggcaatctgtatatccatacctgcaagatggtactcttgacgaagtgttttcatataaatcagaacacgaaggcggcaagacagctgaagaatataaagagtattataaaaagggctatcaaacagatgttgaccgtattgtaatccagaaagatactgtaacgttcttcaaaaatggaaaagaatattctggtaagtatacgtatgacggatacgaaattctaacctatgatgcgggcaatagaggggtaagatacatattcaaactagctaaaaaagcagaagggctgcctcagtatattcagtttagtgatcatagtatttacccgactaaagctagtcattaccatctctattggggggacgaccgtgaagctttacttgatgaagtcaaaaactggcctacctactacccgtcaaaaatggatggacacgatattgcccatgagatgatggctcattaaatgatgattactctatgaaagttgttctgccatagccattttttctgtggagaattgatagaatggggaaaaactgattgagaccattcagtatccgccatattattgtgacgtggcataccttgagtcatctcacatgaagagtagaagaaacctatttcaaaataaaaaatcattggatgtatggcagtggattacgcttgaaatctattggcttatatgaagcaaagaagagacccaaagaccgcaaagctttcaagaaagctttgcggttttttatatgtctaagcctcgattcatctcaccataaaaaggtatttcaactttctcttttgatcgacaatagtccataaagggaagaatatttccctcacaaagaagtcgtggcagtaatctccataggtgtgtttgcatggccccactttaatggttttgtttaaatctaataaaaaacagacgccataaagatttcttatggcgtctgatggatatgaggtaaggtgtgttcttaatagccaccaaagaaagatgtcccaacgatgattaataggatgaatagaactacgattaatggaaatgacctcataacatcaccttccttaaaagaggatagtacatgatatgcagatcgagcttattcgatagtgatgctagtttaattgatgtaaaaatattttttagcctaaggctggactgctaactcatctttattagttattggatcatacttatgattttggaatgaatccgtttcaaagtgatgtgttgttctcggccaatcgctggctaatcttcctgatgcaatcgagctatatgaagccatccctcttttatgaaagtacacccaaaacttctctctcttgcagacccttaatcatttgacttgcatatcgagcgtaagcatgcctcatctaaaaataaagtgcaccatctgctatttgttttaacatttttaagacagtgatgcacaccttttgcgttgagcaaatggaacaggctcagaaggggcgagctgctccttacttcacccagataaaagacggggatagacggcatgcaccgaagctaactgaaagttaaattgaaatgaaaaaaggggcatgttaagccccctttaagactatcgagaacttctcaatagcctaacgcattgtatgtttaacatgttttaatttttcacaacggataaactgacactgttgcctgagactgttactttagcgaagtcttgtgtatcaattacaggtgttattgctttgttgtcgatggtgatgtttgtaaaagatgttgaaaaatttgatttgatagattggcgtgaacctgttgttgcaactgtagcgagcgctttccatttggagatggagccgacatttgttttgctgatttctgaaatgagacggccgttgtatcctgcattgtttgtgccccagtatgtagcgcgtgtattgccgttaaggtttttgtagatggtaagttgtacggtgctgccgggacggaagcctttcgtattcgtaaattggcttcctccttcgaggtactgaacctgatcctgtccttttgaaccgactttcatatatggtttccatacgttatatttatcactgtactgaaacccgatatcggattctgtgcccccgctaaagccagagtagatgtaggctgtcccatttgaaacctgaatggagctaggaagctggatttttgtaacaaaaatggcaccagtgctgttcaagtaagcccttccgccgattccatcagttagctgtgatgcagcttctgcggtttttggactaataatacccggcacatctactgcacatgtgccaaaaagcacagttgccgtaagcgcacccgcgagcagtccttttttcatcatcattatttccccctatcattataattagaaaacgctatcatcttgtattataaaacattatgaaaataattccataatcaacatgaaaatagacacagaatttacacattatgactttgtgtatctggcaaacggtcgatttctaatctcgaaaaatgtcctgtgaagtgtaaatgttacgataacttttcaatcgagacttgtgttttattgaaatagaaaagctataagagatgggggagaaataagaggggaaagagcgaaaacactgtaatcagatatgtgtgtataactcaattgtttgttagaaaaaaagtgggctttttaagcccgcttcttagttcatgtttctcttcaggagattgtctttttcatttacattcaatgtccaacatgactcctttgagtttcatctaatatttcaaacaatcttttgtactttgatatgactacttggtccacaattttatggccagaattgaaaaaggtgattgagcccgatcctttaccaagctggttacgatctgcaagaacttttttcaactgttttgcagtaccgacactgcctgaaatcatatcaacttttatcccaaatagtttttcaaaactgtttttgaaaaacggaaaatgagtgcatcctaacacaatcgttccatattgtttcagatcaaaagaagatagttcgttctttagatatttaatgattttgtcttcactaaaatcaaagttctcagcaaattcaactagtcctggaagagctaagcaatcaacaaggtcatggtgatcaatttctttaactagattatgaaatttctcttctttaagcgtcaaattagtagcaactaccagaactctttttctttcctctgtacatttatttatagcaggctttacagcgggttcgattccgattatcggaaagtcgaagtttctccgaagatcctctatcgcaatgctagtagctgtattacacgcaataacaagagctttgatattttgactggccagaaattcagctgcattgaaaatatattctttaactttaccctttgatttttcaccgtatggaacgtttaacgtatctgcataaaaaatgtaatcttcataaggaagaacttttatggcctcatacaatacagtcatgccaccaattcctgaatcaaaaaatgtctcattctttttttatcatatgactttatatcatctgaatcaaacgaaaaagaaccattttactattcgaatttaatatgggagttatcgatttttcgaataggcagcaaaacttgagaaggggagataagatcgaaatgttggtgatgtattgtggtgaaatcatcaagatcgcaccgtatcaatgggatgattttagctttgaaaatgtagagtatttagatttccagagtcaggggatgaaattacgaaaaaaaagcaaactgcctgtcgaagtttgctttttgctctatcaatgaggtgcgcctatatttttatatcctcttggcaaagctgatttaaaagctgcttaaccgaaatttcctcagtcaatgaccgtatcccttgacctgcccataaagacatctgatcatggttattttgaagtgaagccttctgtctcattgccttcgttagtgtattttgataagggtacggaagggtttgtgtctcaaactgttctttttcttccatccatttatttacgattcctctggcctctttacctgaaaataatgtcgtaagctttgtatctgcttcgtttgcttctagtattttctgtttatgtactggatgtgcgttactctcgtgacaaattaaaaaggcagaaccgatttgaacgccttgggctccaagggttaaagctgcttttactcctctgtggtctatcattcccccagcagctatgacaggtacgctcagtgcatctgctgcttgtggaatcagagccattaaacctacggcagattcacctttggaaggtaagaatgctccgcgatgtccaccggcttcacttccttgaaggactactatatccattccccgttcttccattaacaatgcttcttctactgttgaagcggttcctattaaacagcatccagcggtttttagctcctttactgcgtcttcaggcggcagatcaaaagtgaatgagcaagccttaaccttatattttaaaattagatcaattttttgatagaagtcatcccactcttcttgtacagatgtgaattgatttacttgattagctaacggtatgttttctttccactttttaatctgatcttctggtggcatctctagacctagcggaacaaacacattaatttgaaaaggagcgtctgtcagctcaaacatttcttttatctgttgttctagcaggtctggcgtaagataccccgatgctaagctgccaagagcaccttgattcgaaactgcagatgcaagtcggggcgttgtaataccgccagccattggagcttgaataatcggttttgttaaggaaaacttcttcataaattcattcataccgaatccccccgttaagacatgatttttgaaaaaagtgtcattttaaaatttgctcaaaaactcgtattcgcttaaatatatcgttttccttctttttgtcaatctctcataccagttaacatgtcgataaagcaggggggattaaagtgtgtcaaagatagtgtcgtcccctggcggctctacaaaaaactgaatattcatgtagtccttcatagttgatatctgattttgagatgtcttgcatcttaattttgaatgatatatagaaggacttcatgtaaaataaagcttagaagaatacatcacattcaagagtaaaaaaatctataagacgtacagatcaatattcggttttacagttagatattaaggctgaaacggaggaacatgcgatgcgaagtgagcaggaaatgatggacatttttttggactttgctttgaacgatgagagaatccgattggtcactttggaagggtcgcgtacaaacagaaatatccctcctgacaacttccaagattatgacatctcgtattttgtaactgatgtagattcttttaaagaaaatgatcagtggctcgaaatctttgggaagcgcattatgatgcaaaaaccagaagatatggagctttttcctcccgaattaggtaattggttttcatacattattctttttgaggatggcaacaaattagatctaacccttattccaattcgtgaagcagaagactattttgctaataacgatggtttggttaaggtattgcttgataaggattcgttcatcaactataaagtgaccccaaatgatcaccaatactggatgaaaaagccgactgcaagggaatttgatgattgctgtaatgagttctggatggtttcgacttacgtagtaaaaggattagcaagaaatgaaatcctttttgccattgaccatttaaatgaaattgtacgtcctaatttattgagaatgatggcctggcatatcgcatctcagaaagggtattcatttagtatggggaagaactataaatttatgaaacggtacctttcaaataaagaatgggaggaactcatgtctacatattctgtgaatgggtatcaggaaatgtggaagtctttatttacttgctatgcattatttagaaagtattcaaaagctgtatcagaaagtcttgcatataagtatcctgattacgatgaaggcatcactaagtatacggaaggtatttattgctcagtaaagtaataagaatataggattgttttcatatgatatttgattctcgctgacaatggagaccaaggagtcaccatgtttgtaaaaagatgcgtaaatcgttatgtttaagaatgtctacgcattttactatgattattcttgtccaaaatttttgttctttttaacgaaacgaggcattataattaacctataggcacattaaaaaaataatagaatgtaaaggaggatttttgtgttccaaaccttagaccattttttgaaatcttgggagttcgaagcagatgctacacagaaactattaaatagtctgactgatgaatcacttaaacaagaaataacttcacaaaattggactctaggccgtattgcttggcatactgttgctgccattcgcatcattacctcaaacacagacttaacgttccatgccccagctgaagattatcctgttccaacttcggctcagtttatagctgacagctatcatcaagccagtaatgcatttgtacaggcattaaaaacccaatggactgaccatacacttcaagaacgtatcaactttatcggacaacaattgcctaacggttcacttttgatgtttttaattcaacatcaaaatcaccatcggggacaaatgactgttcttatgagacaagcagggttaactgttccaggtatttatggtccagcaaaagaagaatgggcaaaatttggtttggaagccccgaaaatgtaatcaacctttttataaaaaagttacgctatgacaacatatataagaagatgttttgatctatcttttttcaaaacatgttctttttttgttcgtttaccaatgataagaacatattcgaatcatttttattccaaaccacttcaaatgacaacgttcttccgctttattgttggcctattcccaacgatgtaagtataatttttaatgctgtcaaatcttcgatacacatatctatagattcctctctaacaaaacccccgctttttctgccatcactcgaggtggggaaggcatttcatttttcaaccaccattcgactactcctacgtatgcatttgcaacaaattcagcagcgatcgatggttcagaaattccaatgaaacattcaggtgttgctcaatttttgaataaaagcagctgcgccaaaaggaagcctattggaagagtctagctgagttggaacgtcttctcaaaagggaaggcaatttatttactgtaattcatacaatgagtaaagcctcccaggtataatctttacttcgttcgacaaattctgcaaattgtagacaacttcctgattatttggataattaactgaataggaggggaaaagttgtcatatttcattatacttatcatcgttctattatcggagcattggtaacagcagcagtcggtatcatctcttcaaaagtagaggtaatctcgccgaaaactacaatagaatctaaagaggaagaacagaaaagtttttatacgctgaaataaagcagagaaagagcatctcctgcgggggtgttttttatagaggagttggaaaaactgaatcagactaatttacttttaagattcacccttgaaattgctgcactaatctccttaggggtgtatgcttggataagctttaatggttattttaaatatgttttaactttggttttacctattgcagttatgattgtctggtctgtatttgcagtacctcatgatcctagtcgaagcggacaaactgtaatagctgtaaacggagtaacaaggttagttattgaattattgatctttgcaatggctgttgcagcgctttattttagttatttaaaaccagttagtattgtctttttatgtcttataatactccactacatcatttcagctgagcgtatcaaatggcttctaaatcaatagtttttcatttcagcactcgttattagagtgttttttattattctctgtagagccagtgattctcagattagatttgaaggttaacggcttgggcacagttgcagtatagaacgcattttccaataaagaaggcgctcatttgaaattcatcattaaacaattgtacaaaagtaaaatttgtatttagaatgtagtaataaatagaaattctacgtaggagggtatcttgtggaagaaaagaaagctttaatcattgtggatgtacaaaaagccttcgatgataaaaaatggggggaacggaataacgtaaaggcggaagaaaacattagtaaaatactaaaattatggagagaaaaaggatggacagtcatatacatacaacacacttctgataaacctcattctttattccatccaaagaatgaagggtttgcgataaaggaaatagttaagcctatggatgaagaagtcattataaccaagacagtaaatagcagctttattggtacgaatttagaagaattcttaaaattaaatgaaataaccactgtagtcataactggtttaaccacgcctcactgtgtatcaaccaccacaagaatgagtggtaatttagggtttgatacatacctgatttcagatgcaacagcagccttcggaatgagagaccaaaatgatacatattatgatgcggcgactattcataatatatctctagctacattgcatgatgaatttgccacaatattgacaactgatcaattaataaatgattttataaaaactcactgatgaaaaacattttggcacagtaaaacggcaggcgcctttccaataggaagggcgctttaattcgatttcctgctttacttgctcaaaggagatgtatcaatgtttctttatcgacaagcaagagcagatgaagtaagcaaagtggcaaagctattccatcaatctttcaatcaatatccttttatggatttactcgtaaaacgcgaaaaaaagatcattcatttatttttgaaatgcataaagtactgacaagagcatattttaaaaagcatttcttttttgttggcattcagaatggtgaaatggttgttgccgctctattaaaacatcgtgataaacccgacattaaacttgatcgattatatagcagcaggggggataacattaatcaaaatggggctaaaaaattttccaaatccttaaaagagccggcatagaagtattaggagtttcgccattttatcagggaaagagtttaggcagcaaaatgattaatgactgtctcatatcttttatttcaaaatgcggggacggcattttggcccttatcatgaatactgatctcaatggatcattttacaaatcgtcctgattttatatttaaagattatcataacctttcaaagatggaggtcgaatgaatgtcttcaaaagaaaaaaagagtgtaaccattttgacggaaagtcaattgtcttcgagagcatttaaagatgaagcatatgaattttataaagaattgcgaaaatcacagcctctctacccattatctttaggagctctggggaaaggctggctcatatcgagatatgatgatgcaatacatttattaaagaatgaaaaattaaagaaaaactatgaaaatgtatttaccgcaaaagaaaaacgtcctgctctattgaagaatgaagagactttaacaaaacatatgcttaattcagatccccctgatcacaaccgcttgcgaactcttgttcaaaaagcatttacgcatcggatgattttgcagttggaagacaaaatccagcatatcgcagattctttattggataaagtgcagcccaacaaattcatgaacctagtagacgattatgcgtttccattgccgattatcgtgataagtgaaatgctcggcattcccttggaagatcgtcaaaaattcagagtatggtcgcaagcaattattgatttttcagatgcccctgaaagacttcaggagaatgaccacttgttaggggagtttgttgaatatctggaatccttagttcgcaaaaaaaggagagaacctgcaggagatttaatcagtgcattaattcaagcggaaagtgaaggcacacaattaagtacagaagaattgtactcgatgattatgctgcttatcgttgcaggtcatgaaacaaccgtaaacttaatcaccaatatgacatatgctctgatgtgtcaccatgatcaactagaaaagctccgccagcagccggacttgatgaattcagccatagaagaagcattgcggtttcacagccctgttgagctaacgacaattcgctggacggctgaaccgtttatactgcatgggcaggagattaaacggaaagatgtgatcatcatttctttagcatcagcaaaccgtgatgaaaagatatttccaaatgccgacatatttgatattgaaagaaagaacaaccgccatattgcttttggccatggcaatcatttttgtcttggtgcacagctagcccgcttagaagcaaagattgcgatttccaccttattacgccgctgtccaaatatacagttaaaaggcgaaaagaaacaaatgaaatggaaagggaattttctgatgagagcactcgaagaactgccgattagtttttaattttttggggatatgtgattttcaaacatatcttgttttactcctcaattagattaaacgatagtaaaagctgtaacataaaaatttgatatgatagctttttaaaaacaaagtttagcattatttatgcctaccgggtatgaagatgtcttgcaaacaccaatagtttcatcctatcggtgttttttatttgttttcagcctcatttggacaaacagctgttacatagtaaacgtttgttaagataaaataatggagggcatagtttctaatgagaaaaataatgatagatggaaaagactttgaaaatatagaagttttacatgatgttttaaaagataaatctttatgggattgcctgacagggtgggtggatttgccgctcactttagtcttgaaaaattttgagttcagcaatacatttttaggttcatacgcagatgatgtattagaagttttacaagaggctcaagaggaactagaggacgaatttaaaataataatagagtagactttctgttttgtgaattttaacaatttttgttcgcagaaaaaggcaatagggcaccgcaaattcaattttcggtgagaccgcaataactttttggcttctgataagtttcttatgatgttggtatcaagtcacacaagtacataactctcccatgacttctttctgatgtaagttaatttcattatgaggtaatcatggggataattttattctgtgaataatattttaaaaggatttaaatttaaataatattttattaacgaataaaaattcgttattatttaaattgagtgaaatataattctgttaagttgtattgggggttgtgaaatgggtattatgcttgacgaaactgataaggccatcttaagagaattgcaggaagatgcttcaatatcaaatttaaatttatctaagaaaattgggctttcaccatcagcttgccttgcaagaacaaagaacctagtagaagcaggtataattaaaaagtttacgactattgttgatgagaaaaaacttggaatcgaagtcacagcactagctctcatcaacttatcacccttaaatagggagacaattcattcatttttagaggatataaacaaattcccacaggttcaagaatgctacacacttacaggaagccatgactatatgcttaagattgtggcgaaggacatggagagttatcggaattttatcattgattcattaatgcagaaccctgctattagtggagttgacacaagcatagtcatgagtacagaaaaaagaactgtcagtgtgccaattgatgaaatgtaggaggttgttgatttgaataaaaataaagaatcgttacatttaagctctccagctataaacactcatatgaataagagaagtcaaatatgggctgcatttcgttctgcattcccatatacaattccgatttttgcggggtttttgtttttggggatagcttatggaatctttatgcattctttgggatttagcgcaatctatccaatcatcatgagttttatgatatttgcgggctcaatggagtttgttgcagcgaattttttacttggtgcgttcaaccctatgaatgctctttttttgacgttaatggtcaatgccaggcatttgttttatggaatttccatgttggataagtacagggggactggaaagaaaaagctttatctgattttcggaatgtgcgatgaatcattttctatcaattataccgctaatgttccggcgaatgttgacaagggctggtttatgttttttgtgacactgcttaatcatttatattgggtcgcgggggcagcgataggaggtatttttggatcgtacgtgaagtttaataccgaagggcttgattttgtgatgactgctctgtttattgtgatattcatagaacaatggatgaaagagaaaaagcattacagtgctctctcaggacttggactttcagtagcctgtcttatcctttttggcggaaaccaatttattattcctgctatgctcgccattttaggggtactgactgttctgagaaaaccattggagaaagctgaggtttccgtatgacgatgactatgacgcagcaaatgatcaccattgcaatggtcgtgcttggaacaatgctgacacggttccttccattcatgattttcccgtctggcaaaccgacaccgaaatatgtacagtatcttggtaaagtgctgccatcagcggtaatcgggcttttggtcatttattgtttaaaagatgtgagtctgctttctggaagtcatggcattcctgaattggttggagcagctgcagttgtactgcttcacttgtggaagaaaaatatgctcctttccatagcggggggaaccgttgtttatatggttttggtgcaattggttttttaaccgatatcggaaactatcaaatcatgcttttattaaacttgataaaaatatataaaactgacacaagcttattttggaatcaacactgtgccagtgcaaatagcatctgtaatgtttcctggctattcaagaagtgtctactttaatcggaggatatataatgtcaaaaaaagtgtctgcttcctatatcatcattataggattaatgctatttgcattgttttttggagcaggaaacctcatttttccgcctatgcttggtcaaatggctgggaaaaatgtatgggtcgctaatgcaggtttcttagtgaccggagttggattgccgttactggctataacagcatttgttttttcgggtaaacaaaacttacagtcgttagccagccgtgttcacccggtgtttggcattgtatttacgacgattctctatttggcaatcgggccttttttcgctatcccaagatcaggaaacgtatcgtttgaaattggggtaaaaccttttttatcaaatgatgcaggccctgtctcattaatcttatttacaatattatttttcgcattggcatgcttgttatcactcaatccttcaaaaatcattgatatagttgggaaatttttgacgccaattaagctgacatttatcggattgcttgtagtggtagctcttattcgcccaattggaaccattcaagcaccatcaaaagggtacacatcacaagcgttttttaaaggatttcaggaaggatacctcactctggatgcccttgtagcatttgtttttggaattatcatcgtgaatgcattgaaagaacaaggagcttctaccaaaaaacagctgatgggtgtttgtgcaaaagcagccgcgattgcagctgtactcttagcagttatgtatacagccctttcctatatgggggcttccagcgttgaagaactggggattttagaaaatggagcagaggttttggctaaggtttcatcctattattttggttcttatggttcaatcttattgggcttaatgattacagtggcgtgtctgacgacaagtgtcggactgatcactgcgtgttcttcattttttcatgaactatttccgaacatttcttataaaaaaattgctgtcgttttatcagtgtttagtacgcttgtcgcaaatataggattaacccagctcattaaggtgtcaatgcctgtcttactgacaatgtatcctatcgcgatttccttaatatttttaacgtttttgcattctgtatttaaagggaagacagaagtgtatcaaggcagtttattattcgcattcatcatcagtctatttgacggtttgaaggaggctggaatacaaattgaagttgtgaatcgtattttcactcagattcttcctatgtataacatagggctggggtggctcattccagctattgcagggggaatatgcggctatatactgagtatattccgaacaaaaacaagttgatcaatcaacagcaatatcactcagatctgcaggatcttctccatcagtggatacttcaactgttacaattggatgttctgcccctgtccaaccgaaaatatcaatcttcccgttgtcacccgaaatctgtaggtgaatatttaatagttgtgagagcgattgactctttaggaaacagtcagcctttaacttcaagacgcaaccaagtgtctagggcaatgatcttcgttcaaaattctttgaatgaggaaaatctacattctaatatcgactaggtgtcacaattcagagtgcaaaatcacgaagaaaaagcaaactacataccgaagtttgcttttgtgctctatacaaacaatgagatgcgcctatatttttatatcagacaactgatcagaggtattttgaggcgaagcctgccttccatccatttatttacgattgatctggcctctttacctgaaaatgatccctcatatgcgttaaaaaagcagataaagcaggggtaattaaagtgtctttccgccttataaacatggttgatacgaaagaatatttgtcagagatagtgtggctgcgaatgcggccttctttttcatgcgaagcaatgattgaacgaggcagcagtgaaatccccaagccggcgcttacacagccaatgatcgcttcaagtatgccaaattccattaattttataggtaataaaccttcttcttggaggatatgattgagctttgctctgtaagagcatcctttacggaatacaagcattgtttgtgtttgaacatcctgaatggaagaaatcacagggtgtgaagcgcttgtaacaagaaccatctcttcatccaataccttttcttgaactaaatcagggtgttcaataggccctgaaataaaagcgccgtttaactcataatgtaaaactgcttgtatttgttgttccgtagggccggttactaggttcaaatcaacatttggatagaggttattataatgtgcaaggagttgaggaagccaaactgcagctgttgtttccattgatcctatacgcagtggcccagaaggcgcggatgattcgcccatggctgctctagcttcttcaatagtatgtagaattttctctgagtaagaaacaagaatttgccctgggggagtaagtgtgattcctcgactatggcgatagaataattttgtctgtaaatcgttttctagttgttgtatcttattcgttacgttcgattgtgcataatttaaagtctgagcagccttggaaatactgccttcacgagcagtagtgagaaaaacctgtaacaactgaatattcatctagtcctccatagttgatatctgattttgagatgtcttccatcttaattttgaattatatatgatagcagagcttcatgtaaactaaagcttagaagaataaatgatttctaaagtaagtgataaggctatttcaaaaaatggttaatttactcgaagttgattctgtatattgcctatggaaatacacatcataacataggcttgactaacaccagaatgaaggggttattgggaaattactttattctaaatgtagcagctgcttggaaatagctgacacattaacgaatgaaattaaaaagactgttgtagtagaaggaggggattttatgccattacttcgttttgacttaatagaagggcgagatcaatcaagtttgaaaaaacttttagatgtcgctcacaatgttgtagtagaggcttttgatgtgcctcaacaagaccgttatcaaattgttcatgaacatccagaaaatcatatgattattgaggatactgggttaggatttaaccgaactaaaaatcttgttgttctttcagttacaagtaaatcccgaccggaagagaagaaacaaaaattttacaggctgttagctgaaagactggaatctgagtgtggtatcgcatcaactgatttaattgtatctattgttgaaaatgataatgctgactggagttttggacttggtgaggcccaatttttaacaggtaaattgtagttgaatactaccctcaaatgcttgattgaagaaaaggatagagaaactagggtagcggagcaaaccatgtgtttgctccgcttttttatgtttataaaagaataattaaggaggtattgtggatttctataaaaaatattttgacatttcagtaaagagcagatatatttatatatgaacacatgctcatatataaatattgtttgcattatgttagaatgcttcataacagatttgaaataataaatacatatgtatcaataaactttaggtaaggaggagttttttatgggtcacaatcatagtcacaatcatagtcacaatcataatgaaggagcaaataaaaaggttttattgatctcttttatcatgattacaggttatatgataatagaagctataggtggatttttaacaaatagtctggcgcttttatctgatgcaggccatatgctgagtgattcaatttcattaatggttgccctgattgcttttacattagctgaaaaaaaggcaaatcacaataagacattcggctataaacgatttgagattcttgcagctgtgataaacggtgctgccttaattcttatttctctttatatcatttatgaagcaatcgaacgcttctctaatccaccaaaagtagcaacaaccggcatgcttacaattagtatcatcgggttagttgtgaatctattggtcgcttggattatggtgagtggcggagatacaaagaataatctgaatataagaggagcttatttacatgtaataagcgatatgctcggctctgtaggtgccattttagctgccatacttatcatcttctttggatggggctgggcagacccattggctagtatcattgtggctattcttgttctaagaagcggttacaatgtgactaaagattccattcacatattaatggaaggaactccagaaaatatcgatgtctatgatatcattcgtacaattgaagggacagagggaattcaaaacattcatgatttacacatatggtctatcacaagcggattgaatgctctttcttgccacgcagttgttgacggtcaactgaccatttcagaaagtgaaaatattttacgcaaaattgaacatgaacttgagcataaaggcattacgcacgtaaccattcaaatggaaaccgaagcgcataatcacgacaatgcgatcctttgtcaggccaaaattgagaagccgcgtgaccaccatcaccattaaattttttatctaactttatagtgaggagatcaactagcattttgcagattctgtctactgacaatttgaaattggcggggtgataatgtgtacgacactatagtaatcggggctggtcaagcagggatctcgataggatattatctaaagcagtccgatcaaaagtttattattttggataaaagtcatgaggtgggggagagctggaaagatcggtatgactcattagttttatttacttctcgaatgtatagctctttgcctggaatgcatcttgaaggagaaaaacatggatttccttcaaaaaatgaaattgttgcttatctaaagaaatatgttaaaaaatttgaaattccaatccaattacggacagaagtaataagtgtcctaaaaataaagaattatttcttaataaaaacaaatcgggaagaatatcaaacgaagaatcttgtcattgctacagggccttttcatacccctaatattccatcaatatcaaaggatttatccgataatattaatcaactacactcatcacaatataagaattcaaaacaattggcatatggaaatgtactagtagttggtggtgggaatagtggtgctcaaatagctgttgaattatccaaagaaagagttacatatttagcctgtagtaataaactagtttatttccctttaatgatcggaaaaagaagcatcttttggtggtttgataaattaggagttttacatgcaagtcatacatcagtagtaggcaaattcattcaaaagaaaggtgatccagtatttgggcatgaattaaaacatgcaataaaacagaaggagatcatcttaaaaaaaagagtcattgccgcaaagcaaaatgaaatcatttttaaagattcatctacattagaagtaaacaatattatttgggctactggtttcaggaatcccttatgttggataaatataaaaggtgttttggataaagaaggtcgaatcatacatcatagaggtgtttcacctgtagaaggattgtactttatagggttgccttggcagcataagcgaggttcagcgttgcttcaaggtgtaggaaatgatgctgaatacattgtaaaacaaatgaacggtggataaacgaagcagagcagtaactcacatgtttactgctctattttttgcgtgaataagggtagcgaagtggagatgcgctttctcttttatttaagaagttaacatagaaagagaaaaagcactttaagacatactcatatttttatgttcaacaatggtcttaaggaggctgcgcattgaatttgtcaggtacgcatctttatggcgtataaagattgttgagatacagctgtctttctcaggcaatgggtgacaataaaccttaccttgtgcagctagatgcataacagcagattccggtaccactgttataccgagtccaagtgcaacactatttaagattgtctccaggatgttaaattccatcattctgtttgggagcacaccttcatctttgagccactgttcaagcctagaccgatacccgcacccctgattaaaaacaagaatcggagtcgttgaaaaatcctctatattaaacgttttgttactggttacaagagtaagtctttcagtataaacatcatactgttccagaatagaatgtttcaaagggcctgaaataaaagctccgtctaattcgtgattcatgacctttttaataagttcctctgttagaccagcctgcaatgataaatccacattaggatactttttataataggaagctatgatggtcggcagtatcctcactgtttccactgtaccgatttttaatattccagacggtatgtcagtatctagaaagacctgctccagttcttcaacatctttcaaaattttgttaacgtattcaatcatttttcggccctctgggcttagtgaaaccccttttttatggcgattgaaaagaggtgttttgagctcattctctaattgcttaatccgcgcagttacattagattgtacataatttaactcttttgcagcaccggtaatactcttgtgatgggctacgcatttgaaaatttgtaagtctcgcagttccatgaagatccccccttcattaaagtatcattatcaatgatgtttttcatcacttttgttcattttacttgatgcttacttctttttataattctcattgtaattttaaagaaaaggaggggaattcaatgaaaaaaagtcaattattcattggtgcccttacatgtttagtagcaagtatgtcttggggcgcgatgtttccagttgcagatcatgcattagaatttattgatccgttttatttttcatttattcgctacggtgtggtaacgattatgttagtgattttattattggtgagagaaggaaaaaaatcatttcatttagagggtaaagcaaaatggatcattttatttggggtgatggcgtttactgtatacaatgttcttatttttttaggtcaaaggttgatggggaagtctggaattatgacagcatccattgccgaggcactcatgccaatgctttcaattgttattctatggggatataaacatgtgaaacctaaaaaatacacaatgatcagtatattgattgcctttttgggggcttcgatggtcataaccaaaggtaatataagtttcttttttttattgggggatcatctattctcgctactctttatattcattggtgttttagggtgggttgtctacacaatggggggacagatattccgagagtggtccacacttcgttattcaactttgacatgtttattcggcacagctataacaggaatcatgacagctatacttaccgcgcaaggttacgtgtcggtaccgagtattaaagtgattgcagcaattaagtatgattttttatttatgattactttaccaggtatcatagccctccttagttggaactatggcattaaaatcctatcatccattaatgggattttatttattaactttgtccccattactacattgttaatcatggtgatcaaaggatataacataactgcatttgatatagtaggaacactgtttgtcattattggactcattttaaataacatatatcagcgtaaggaagattataagcaggtattacaaaaagaaaaaacaaatttgactatcacttagacggtgggggatttaaaatgtttgaaggtttattgtttttcatttcagctggaattgtctgtgaacttgctgcaattaatagaaatggccgcaaaaatataaagcaacaggcggaattgattcaaattttaaaagaaaaccttaataaagacattaaataaatcaagacggttggatattattgaaacacaccagaaaattcaggtgtgtttttattttgctttctattttaagtcttaaaacgtcaccaatcgctagttgaatactacgggaaccactctccatacggaaaaagatgattatttacatcattcagagttgattttaggttcttttgaacttataatgttatatatactgttttttgtttattcagaaaaaacgggttataaaaataaatatttatatcggaggtgtacgccttactaggtaaggcaaatcattgacaaccattaaccttataatctttactattttaattgtcttaacagcattttttgttgcgactgaatttgcgatagtaaagatcaggtcatcaaaaattgaccaactcatattagagggaaaaaaaggtgccgtatcagccaaaaaggtcattactcatttggacgaatatttgtcagcttgtcaattagggatcacggttacagcgttgggaattggctgggttggagaatcgacttttgaagtgattttgcaccccttatttgctcattttcatgtaagtgaaacagtctcacatgtattgatcttagtgattgcttttgtgatggcgacttttttgcacgttgtagttggagaacttgctcctaaaacactcgctatccaaaaagcggaaaccatcactcttttgactgcaaagccaattatttggttttaccgcatcctgttcccttttatatggtttttaaatggttcagcccggtttatagtaggactcttcggtttgaaacctgcatcagaacatgaacttgctcattctgaagaagaactgcgcatcttactgtctgaaagctataagagcggtgaaatcaatcaaaatgagttgaaatatgtaaataatatttttgaatttgatgaaagaatcgccaaagaaattatgattccgagaagagagatcgtagcgatttctagtgaggattcttatgaaactattgttaagaccattaagacagagagctatacaaggtacccagtcctaaatggagataaagattcaatcattggttttatcaatgctaaagaatttttgtcagcttatattgacacagaccagaagataaaagaggatttcaagttagaaaatcatatcaaccctgttatccatgttattgaatccgttccaattcatgatttattggtaaaaatgcaaaaagagcgaacacatatcgctattcttgtggatgaatatggcggcacttcaggtttagtcactgctgaagatattcttgaagaaattgtcggggaaatcagagatgaatttgataaagatgaagtgcctaatattagaaaagtaaatgataatcactatatcttagattcgaaagtgctcattgaagatgtaaatgatttattgggaacgacgttagcaagtgacgaagtggatacaataggcggctggtttatgactcaacaaatagacgctgcagttgggtccgttatagaagccgatgggtatatttttaaagtgcacaaaacagttggccggcatattaattatttagaaattgtccggaaaaaagaataacatctggataaaacacatgagattttgactaataagatgcttaaagcctgagatgaaattttcatccaggcttttttaaacaatgatcttgcagtttaagtaggtaatcattatcgaagttcaaacgtttctcagcaaaaaaggaggcctggatatctatagctcttttaccattaccttctcaccattaaagtcgagttcaccattaaattgaaaaccaaacctttgataaaggcgtatagcatgaatattattttcaaatatacttaaataaattcttttgcatttatatagctcagcaaggtgctgaatgagggctttaagcattttcttccctaatccttttccctgatagcgttcgtcaataaaaaatcggtcaagccagactcgtccgtttttattatcttcatcatactcgggaaacaatccatacattgcaaaaccgactagatctccttcatagtaaagcccgacaggtttataatagtgacattcgtttgcatcctctaaacatatttttgtagattcaatatatgataattgattctggctgacatgtagatcaagaattgcagcacgattatcatcagttactccttttatttttatactcatactacattctccttttttcttatcccggtatcctgatattgctaaaactcagcttaaactatattcacgtcaagcaacatgtagcctatcaaattaagtaccttttcttattgtgcctaaccaggggcattccctgcatccaaatgacttgactttatagaaaatgaattaattcaaagctgcagcatcattctttttttctttccaaaccattgtaagaccaaggccgacaatcataacgaaacctgcaaaaaggaaaggataatgaatgttaagatcaaatagtataccgcctagagcaggtccaaatatatttcccaggctggtgtatgtggagttcatgcctgctacgaaaccctgctggttaccggccatattggataaatgagcggttaaggccggacgtagcaaatcgaacgccagaaaaataaaacaagttacaagcaaaacagttaaaaatcctgacataacagtagacacgaaagccaagatcgcaccggttattaagcacagctgaatcattcttttctctccaagtttgttgaccaatttcccgaaaagtaaaacttgaataactaccgcaacaatggagctaatcgtaataatggctgcaatatcttttggtgtgaagccaaatttatgatcagaaaacaagctgaataccgtttcataagctgataaaccaaaagccattacaaagacgataataaatgcaatgaaatagacaggatgaatggatctcttcaagtctttaatgaaatttgattcctttgtatgagatgagagttgatggcgttcttctatcgacaatgactcttttagtataaaaacagaagtgacagctgctattaacgcgatggcggaggcgaagaaaaacggcatgcggatgccaaagccggcaataaatcctcccgcaccaggcccaataataaagcctgtgctaattgcagcagaaacataccccatagcctttgacctttcctttagggttgtaatatcagctacatatgctgttaccgcgggcatgataaaagccgcacttacaccacccaatatcctcgagaaataaaatattgaaacatgggtccctaatccgaaaatcaactcagataaactgaatataagcaacccgagaataatcattttttttctcccgaaacggtcaacccacctacctgcaaaaggtgaagtaattaactgagaaatggcaaaagccgcaacaagataacccattgtgctgccggataaatgcatgattttcataaaagaaggcattactggaatgattaaaccgataccaagaaatgctacgaagatgttgcttaatagtataatgaatatcgttttttgctcatttattgattttttcatctgaattccccttttactcaattgaaccctttttacctatccttttcgcttgaagcttttttcaagtacaatcaaatcataaggtatatggttaccgtatagtcaaggaggtttttatgagcgaagatgttaagaagtatttcacaacaggggagttttcgaagctctgccgtgtaaaaaaacaaaccttatttcattatgatgagattggtcttttctcgccggaaataaaaaaagaaaatgggtatagatattattcctatcatcaatttgagatttttcaagtcatcagtctatttaaagagcttggggttccattaaaagaaataaagtgtctaataaaaggaaaaacaccagacaagatcctgcatgttctaaaagaaaagtctattgagattgataaaaaaataaatgagcttaagcagttgcaaatgatcttacaaacaaaagtgacgcttacagaacaagcacttgagactgatttttcctcaatttcttttgaatatttaaatgaagaaacattcatgttaagccgaaaaacattaaacttaccggaacgaaaatatgtggcagccatttcagaactcattcatgaagttcagcaatatgaattagatgaaggatatccgataggcggaatctttgcacgggaacaaatcttagaaaaagacttctacaattacagttacttttatataaaagtaaaagatggggcagagaacataaattatcatgtacggccaaaaggcctgtatgcagttggatatgaaataggcggaaatactgaagaggcgtaccggagaatcattgagttcattgaaagaaatggaatgcaaataggggaaaatgcatatgaggaatatatgctggatgagatggtagttgacgggtatgaaaatacatatgcaaaaatcctccttcaagttaaagaggtgtaagattacgagattttcatatgggaaaattgtttctgttgtgtgcccaaaaagaatataaactggtttactaaaagcgagcccacatacaggagacggtacaaacggcactgggaaccgcaagtctatcggcgttgaaatatgctataacgattcaggaggcgctaaatactacgctgctgaaaagctggccatcaaggcgcatccaaagagataaatctaaaagagctgggataggggggacaaacaacagaattccgtatactctgttgttgtgctatgtaaatgttcaaaagccatttaggatcgtcgacttttgataatccatcatataaaggtgtcattcgatgtcatgttaacaaaggctagtgaaattcaacatccagaaaacgattacaaggtcggtgataaattattcatccatgaatcaaacggtgatcgaacattcatttttgtgtttaatatgagttttcttgatttagcacactcccttaataaatgcataggatactatcacaaaaatttataattgcggggatcaaaaaatgtactataaccctttttcgcctcaatgttattattatgtgactgtgccgatgtataatgatggaagatctgtttattggactattccaaatgagatggagaacgtacacagaggtgccgatttgcgctcttcatatgaagatagaaaccttcttttgagggattatggaccaaaaccatttgttgtaaatatcaatagagccacaaaacaaaacaatacgttccgtactgctttatggacaggaaagcattttcaagttactttgatgagtattggtattggagaagacattggtttggaaatccatcctaacgttgaccagttcttacggattgagcaggggcgtgggatcgtcaaaatgggaaagagtaaagatcatttgaactttcaaagaaatgtctatgatgattctgccattgttgtccctgccggcacttggcacaacgtaattaatacaggaaatacgccattaaaactttactccatttatgctcctcctaaccatccatttggtacagttcataaaaccaaagcagatgcagtggctgcggaagattagcacagatattctgcagaattctagaataattaaagtcacattcagcatgaaacatggggaaccagtaccatgctaatgaaaccccatttaatatccaagcagcgtgtcttgtgctaattttaagtaattgataaataaagccgatttaaaattaaatcggcttattgctttattcgagttccttttagcagaattggcattatcgaatgtaagtattttttcaatccgcggatatcgaaatgaatctatcagctcaaagaaagtaactttcacacttgactatatacctatgggggtatattattgttttgtgaataacaaagagttaataaggtggtgtaagtagtatcaattatttagttattgcattcctgcttatttttgtgattatcattgcaacgtatagacgttattatcctataaccggaatctcttgtatccataaagataaattagaggctatggacatcacaatattagatattcgtcattataacgatgtacccaatttttcggataatattattttaaacatcccatatgcgtatctaaaacgtttttatttagagattccacgtgataaaatacacataatagctcgtgaccgggtggaattaaatttaggagtgcgttttctaaagcgcaaaggtatccatgtaaacagttatgaactggcagcattgtaaaaataaatgaaagaaaggatttcattgatatatggagtatgatcaaaagattaaaaaccgcttacgacggattgaaggacaaattaaaggtgtattgactatgatggaacaaggaaaagattgtagagaggttgtgacccaattagcagcttcccgtaatgcgatcgatcgagcgatgggtttaattgtgagcacaaaccttgaacattgtgttcgtgaaagtttagaaaaaggcgaagacacacaaaatttagtaaaagaagcagtcgacttattggtaaagagccgataaaaattcatcaacctaaggttgacgaatttttatatgcgttatattataccccctatggtatttaaagagttgaataaaagcagatctttcgaaaaaaattttttgacttcaatatacccatgggggtaattagttaggagaatcaacatgacagaacaaacaaaacgcacaacaattgttttatttagcggggattatgataaagcaatggcagcctatattattgcaaatggtgcagctgcctacgatcatgaagtgacgatcttccatactttttggggattaaacgctttacgtaaagaagagctgattccagtgaaaaaaggatttcttgaaaaaatgtttggaaagatgatgcctcgtggtgctgataagatgggtttatctaaaatgaactttgcaggtatgggccctaaaatgattaaaaatgtgatgaaaaagcataatgcacttacattacctcagttgattgagatggctcaagaacagggggtaaagctcgtagcttgtacgatgacaatggatcttcttggtttacaggaaaaagaactattagatgatattgactatgctggtgtagcagcttatttggcagatgctgaggaaggcagtgtcaacttatttatctaatgttactcatttactcattgctaagcggaaggagaagtttaaagggaagtaaaaatattgaagaaacaaggatttaaaaagatcacaaatataaaaggggcatgaatacatggtattaacttctagtgagaaactttttgtatatttatatacccccacccctatatgagaaaaggaggaaaaaatgatgaaagcaactattgtactagacgctaaaggtttggcgtgtccaatgcctatcgtaaaaacgaagaagagaatgaaggatttaaaagctggtgaagtattggaaattcatgcgacagatataagttctacagcagatctggaagcatgggcaaaaagtacaggccatgaatatctaggtactgaagcagagggagaaatacttcgtcattttcttcgaaaaggaggagagcattcatcagaaaatgcatcttcaattcctgagatttcattagaagctttcaaacagaaagtagatagtgacgagtctcttaacattttagatgttcgagagatagaggaatatgaaaaagctcatatccctggagttgtgcatatccctcttggtgaagtggaaaagcgctctgacgaattaaacaaaaatgatgaaatttatattatctgccattcgggaagaaggagtgaaatggcggcccgcaccatgaagaaacaaggttttaaaaaggttattaatgttgtccccggtatgcgggattggacaggtaaaaccgaataaataaaaagcatgatgaacagatgagtacaagagtagcgattattgcggcaaatggcggtctgtttgatgcttataaagtctgtaatattgcgacaaggaaaagaacatgtcgcagaaggttgtaagaaagcaaatgtgccttctattcctaaactgattgaaatgggagttgcatgatttggttgtcaaataacgatggacgttatgggtttaacaaaagatgattttatggaaggaatcgaagtaggcggggctgttaccttttttggttttgcgaaagatgctgatgtatccttaacgttttagtcccgctaaaagatttgatataggaggtattgaaacatgaccgtaaaggcaatgaccccaaaagaagcgacaaaaaaaatctttaacaaagaacctttatttattttggatgtgcgtaatgaaaatgattttaacgattggaagatagaagggcatgactttgaccatttgaatgttccttattttgatcttttagatggcgtagaagatatcttggagaaaattccttctgataaagaagtgctggtcgtttgcgcaaaagaaggttcatccgtcatggtatccgaaatgctttctgaagcaggtcattctgtatcctaccttaagggtggaatgaaagcatggagcgaacatttagagccggtaaaagtcggggatttaaaagatggcggtgagatgtatcagtttgttcgaatcggtaaaggctgcttgtcatacatggtcatttccaatggtgaagcagcaattattgatgcgacacgtatggtagatttctttatggattttgcgaaggagaagggtgcaacgattactcacgtatttgatacacatcttcacgcggaccatatttcaggcggcagagtcattgctgaaaaaacaaaagcaacctactggttaccgcctaaagatgctgaagaagtggtattcgattatcagccgttggaagaaggaaatgacattattattggaaatacaacgattaaaattcaaccgatttattctccggggcacacgattgggtccacttctttcattgtcgatgatctgtatcttctttcaggtgatattttgtttattgattcaatcggcagaccagacttagccggtatggcagaagattgggtaggagatttaagaaaaacgctttatagccgttacaaagcgttatcaaaggatttaattgtattaccggcacactttatgatcattgacgagctaaatgaggatggaagtgttggtaaaaaactaagtacattatttagcgagaaccatggtttgaacattgcggatgaaacagaatttagacacctagtaacagatcatttgcctccgcaaccaaatgcataccaagagattcgagaaacaaacatggggaaaatcagcccagatgaagaaaaacagcgtgaaatggagattggcccaaaccgctgtgcaatacggtaacacaagtttctgctaaaaagaggagagatgaacatgaaatcagataaagtattagacgcaaaaggcttggcatgcccaatgccaattgtcagaacaaaaaaagcgatgaatgaactggaatctggtcaaatattagaagtgcatgcaacagataagggagccaaaaatgatcttacagcctggtctaaatcaggcggacatgaccttttagagcaaacggacgagggcgatatattgaaattttggattcaaaaaggctaatgaatgtgaaagggtatcgaatagaaagatacccttttcctatgaaaggaggcaaataaaatggatattgcctttatcacaactcttttcattatagggtttattggtgcctttatttccggaatgattggtattggcggagcagttattaattatccaatgctattgtacattccttctttagtgggagtgatgtcattaactgcccatgaagtttcagggataggggctattcaagttttctttgcgacactcggcggtgtttgggcttatcgtaagagtggtcttctaaataaagcattaattatttacatgggaagcagcatccttttagggagtgtattggggagttacttttctcattacatatctgaaaaaggaattaactttatatacggaattctggctattttagcagttattttaatgttgatacctaaaaaaggacaagaacatagcgaagacaaagaagtgatatttaataaatggttggcttcgtccctagcgttaatcataggtggtgtatcaggtattttaggagctggcggcgcctttatcctggtccccattatgttatcgattttaaatattcctgtaagaatcactgttgcttcatctcttgcgattacatttctatcatctattggagcaacagttggaaaagtaatgacgggccaggttctttttgtaccagctctggttcttatgattgctagtttaattgcatctcctattggtgcatcagttgggcaaaaagtaaatacaaaattcctgcaatgggttttagcgcaattaataggtgcgacagctattaaaatttggttagagctcctttgatatgagccagcgggtaaaatgaaagattaaaagattcatcactcgttggtttcttattaatgttatgacacttggccgcgttcaataaatgtttcaagtgtttgatgaaattcattttgataatggtgacttggacaagtcttgactatagtaccatgaaatgcatttgacttagtggtgtccagtgttgttttgcattaagacagcattcataaaataaaagagaccataacttaatctttgatcaccttttttaaaacattttaatcctgattggtttaaggggtatggtatgtgatgggtataatgagtcaatataaattatgtctattttgtgcccaaaataaatagagggactcgaactaaaaaagaggatgccaaactatataggtatctttgtttgctttagagttattatatttgaatatgacatgccacgtaacaacacgttattgcacatataattaagaagcaactactaaggcagattcttctctcttttaacaccatatccaatcagcctcaaatgtaatataatgttgccaaaccatattggttgtggcaccgaggaggaaatgataggtggtttatttcgtagcatttttttgttttgctattacacttcataatattgaggaagctatttggttacctgagtggtcacaacaatcttcaaagtttcaaaagccagtaacttcaaatgaatttcattttgctgtcattgttataactatgttggcttatttatctgcatttggttttttatatatgccagaatcagatattgcaaaatggattttcattggctttctaggttctatggttatcaacgctatttttccacatcttatcgcaactgttgtaatgaaaaagtatgcacctggacttcttacgggcttattgcttaacattccagtaaactcattagttatttatcaaatgtttttaaagaatttgattgtatggaaggagttaataatatctacgttggttgtaggaattattttattagcacttattccattattatttaaagttggtgataaagtatctccttaatgagtttaaattggtaaggattgagggaaaaggtggaaattttctaaataatggattattctgttatatcggatttctacaaaacaatgtcttaagtcatcattgattttggtgcccaattagttgccctgaattcatgaaaaaggataaaataggtgtaaataaagttgctattttaaaattagaatcaattcattatcgtaaaaaataataactaattggcaaagaaaggataatcagtctaatgaaaacattagttatcgttatacatcctaatttggaaacgtctgttgtcaacaaaacctggatgaatcgtttaaagcaagagaaagacattacggttcatgacctgtacggtgaataccctaattttatcattgatgtagaaaaagagcagcagctcctgttagatcatgagcgtatcgtttttcagttcccaatgtattggtacagcagtcccgcgttactcaaacaatgggaagatgatgtgttaacacatggctgggcttatggaactggaggaactaaattgcatggaaaagaactactcttagctatctccttaggcgcacaggaatctgattatcaagcaggcggagaatataatatcacgatcagcgagcttatcagaccgtttcaagtcactgctaactatataggaatgcgttttcttcctgcgtttacacaatatgggacacttcatctttcaaaagaagatgttaagaacagtgcggagagattggttgactatcttaaagccgagcattaatccggtattcgcgagggaagctgaaacaaatgatgtgttatgaaataagggtttgtgacagattttcataaacttaatttcaaagttacatcaaatacttaattcagggggggcatagtgcgagggcttaaaattaattaaagcagggcaatgagtacggatttcttaatgaaatgtagagttccttggcctctaataggtacccgatttgtgtccagaattctgaaaaatgatgaaaataagtataaataaaataaacatatgctttgaataaaagcttttgtaactcatgatatgtttttactatgttgagggactagtgggcgtggtatatgtcagaaaagaaaccgatgattcaaaggtgttttgacccctgtttatgagacagggatcaaaacaccttttaaacatcattattaccttcctctgataatgaaatataaaaaagttaccagcaactctctgcggcatctcgccgtgttcaattgtttagtccttttttttcataatctttacaaatctgaaaaagtcatcatcattcagtaggggcttgtcatcttcacgtccattgcgatgcatatgcggatcagagtgatgttcattgtagaactctacgatatgaaatccacacttattcacatagaagttgatatttcgcttttcgaaataaggtgtcacggtttcccaaagcacagtatccggatactgtgcttcaatggctttccaagcagaaagaccaatcccttggctgtgatattctggagatacatagaataaatctagcgaattatgatttgtttggctgttgatacgtactactgcaccaccgacattcttaccatcctgaagaatatgatataccactgctccgggagcattgaaagactcctgaacatcattgtccgatggaatcggcccatcttcgcaatcaccgaacgtttcaatcacggcgatcgcaaaggcttcttgtaattttttttggaattctggcagatcagattcctttgctagttccagaataacttttggttcatttttagttttcatgattgttcactccctcagttgctaaaatatagagttcagtcgttcagtaaaacattcgagctgctctgcgaggccttttcacaaaaaagtgattccatcgctctttcttccgcggtaaatttggcgttaaaatacttcaaaagctttctcctgtctttttgtatgattctttttctttgtttcattggaaaacaagctgcatgtaaccctaatttactattgttcactaccgtattaagtgtcgtatgcgggatttgtcatcattctcgaatttttcctgcgaaaagttacaaaaatagggaatgaggcgcctttgactatgaacatgcgtaaaagattcaatttagattcgatcatgagcaatgcacattgagtaaactctggtggatttattagcccaaagaagcctaaatgatataaaaataactagtccatatatcaaatctgtccgtttaatgctcgcttcattcaacaacactaatttgaagtcatgcaatctgtgcaagggggttatttctaaatagatttttccgaatgcagcggagttgctttgggactcccgtttactttgccgtacgtcagcttgcgccatactaattccatcggaccgtacctaaaccgtttcaaccacaatgtactaaagctcataagaacgaagtacacggccagactgaacatgaacgtgccggcggattgaatatgatccgcaagcccgaatccgtacctgaggaacagaactgttccaatgatagagtgaagcagataacaggtcaatgacatccgtccgactttggtgaatatcatcatagggcctcgcagctgaggaaggtatagaaacagcattgcaaaagtgctcatataaaacatacttccggttaagccgccattttgacccaagacagaggaaatgtccttccacagcatattctcagaaagattaaacatgtctagtaatatactgctttgtgttattagaaaagcgattgtgctaatgatccagatacgcttccatataggctttttcgcttccatgtctttgaaaaattccatcttaacaaagtacacgcccagcagaaacatgagaaacatggaatagatcatagagaaagagccagcagccatcgtgaccatatctgtccaccgagtgctgatggattccatgtaggtaaggctgctgtggctaaacaaagtaaactctgaaaaattcggtttttttgaccctgcagtattgatgacattgtacaacattgtgaaaacaggagtcaggaattgaaacacgataagtgcgataatccatctaagcaccgttttggccgtgcgtttatagaaggcgagtaacaggaagccacttacggcgtaaaaggccaatatgtcaccgacccaaacaaatgtgatgtgcaaaatgccaaatcccaacaggatagataacctgcgggcaaacagcttgttgggactctctaccttctgcgcggctcgatccataaagaccataaacccgactccgaacaggaaggagaataacgtaacgaatttcccttcggcaaaccaggaaaccagcttatgcagtacgtcatcggaggccatttcgaatccctttactgaatctacgatcagaaaataattgacaataataatgccaagcaaggcaaatcctcgtacgatgtccagaaaatgaacccgttcccgcagactcaccggttgcccgcgtccttctttttgtacaatcatatcaatactcctttcccatttatcacggcaatgtgtagtgcggatctgaaaaacttgagccttacaatggataaatataaagaccgaatcttaacaatttatgaagagtcatcattttttttagaaaatgtgacaaatttgtggcgagcatcagctttcataaattgttaagatttacgtagtatcttataacgtacttattactatgaacgatatatagtaaggacacacgagaaataacaacaagaatcatgaggtgagagagacatggcctatcgaatattagtcgtagaggatgatgaggatattggtgatcttttggaggaatcccttacacgtgcaggttacgaggtgctaagagccaaggatggaaagcgagcattgcaacttgtgaatgactcgcttgatttggttattctggatattatgatgccaggcatttcaggaattgaaacatgtcagcacatcaggaaatcctctaacgtcccgattctgtttctgacggccagatcgagtacactcgataaaactgagggattactcgccggcggcgatgattatatgactaaaccattctcggaagaggaacttcacgctagagtgattgctcaattacgcagatatactatctatcaggaaaagaaggaacaggaagaaacatttcttatcgggggcaaactaagagtgagcgaagaatttaatgaggtgtggaaagaggagaagcaaatcaagttgtcagatctggagtatcgtatcctgaaacttctgatgaacaaacgcaacaaaatattttctgcccaaaatatatatgagagtgtgtggggacagccttacttttactgttccaacaatacggtgatggtgcatatacggaagctgcgctccaaaattgaggatgatccggcacgtccggtttatataaaaactgaatggggaagaggatatcgatttggcgcatcttaaatttacgctaaccaaaaaactggctttgctgataatggttgctgcgattgtgagtggtgtgatctttctgacgttgcaaaagatcacagatgatctgatcgagggatatctgagttcggaagagtattatcacaaggagtcagcaagatacattcaaaaattcagcaagtacgtttcagaaaatgagttgtctacatcagatagaaaagcgtttggcgagtgggtcaaaaaagaaaattacattaacctcaccatattcaaggatcaggagctgcaatatgattctatttattccgaatcggattatggaaaggaaaagctgactcagtacgctcaaaatcattcacatcctgtcaagtttagcgatggtgaaggacgagtcattatcgacggtttctactcttcccgatattatgatctggcctttgcattggatttgctcggggcaaccctcatctttttaatcattgttctcttcggaattcgccaaagtcttcgctaccttaaaacgattcatcaagagattcatattcttgaagggggcgaactggactacgagatgacgataaaagggcatgatgaattagcgatgattgcaaagagcattgaggatctgcggaaagctttcctggataaacttaaagctatcgaggaattgcaagctgagagccgcagcctggttaccgaagtgtcgcacgatatgcgcacaccgctgacgtcgctgatcatgaatctggagtttgccaaaaaagagggaggcgaagcgggtgccagcaaagatcggtatgtagccaatgcttatggtaaagcactgcaattaaaaagcttgtctgacaatctgtttgcgtatttcctgctgaacaaggaatatgaggccgatctggagaccgttgcagtgaaagaagtgatctacgatctaatatcagatcagattgctatccttcatcaggagcattttcgggtccatatttcaggcgagctgccggaaacctatattaacgtgaatttggaggagcttggtcgtgtatttgataatgtgatgtcaaacttattgaaatacgcagatccggaagaaaaaatcagtatcacgtttgtatcggatcaagagatatttgagatccatgttagcaatacgattaaacttgcagatataacaccggaaagcaacggacttggtgaaagaagcattgcgcgaatgatgtcccgcatgcagggacagtttcacagtatacaaaagaattctaagtactacattgtgctacgattttggaacaccaagatgtaggctgagaataaaaaccacgaatatattgaaataggagacaacatgatgagattttctaacaaattcaaaaaggtgccttacctgttacaagcgcttctcaacgtctgtctgttctttctggcgttagccttaagcgcacttctgatcagcgagacttggtacattgtgctattcgtatacaagtcactgttcaacaaagtggacagctattatgagatgcttggagaactgcttatattcttcatgtactttgagttcattgctttgattatcaaatacttcaaatcagactttcattttccgcttcgctacttcatttatattggcatcacagctgtcattcgtttgattatcatcgatcatgatcaggcgatctcaacgttctggtgggcgatggccattcttgcaatgatttgtggattctttattgccaatagacgaaattctgttgttgaacattaataaattagttcgcattatgccgatacgccgccgaaatgtcctaattgtgaaagggaactggtacagatttttataactctatctgtttaatgtcagctcagaaatctgtagtggatcaaattgaatcgtggttgtaagtggatatccgaatgtatttattggctactttaacagacatgtcccgatgaaatagcattaactgtttggagatgaaaatcgcttctttattttacaaggaagaggttaaaattcttaataaataagatgaaaaagttaggttggacgtttattgggtttttgtaaccattttttaccataattgatataaacgtatagaaatgataacaaatgaatatatagtgtgtaatgaaaataagctttcataaccaatgagctagatttactatattgagggcctagtgatatagaaaacagatcgatggtacaaaccatcggtttttttatttgttttcatactcattgaaaatcacctcattaggacaaacaggtattacgcagcattacccaaggggtgatgtattttatgaaggtaataatcatcgagggactgcaaactgacaaatgcatgaacgattgctatcattatttaataaaactttataggcaggagatccagggtgatagcaatatatcgtggaacaagcgatcaagggatcgagcatcgacagccagatcgaggcctgtataaagaaagcagggactaaagatgtactgaagtataccgatctaaggattttctcaggagagcttttagaacgtccggctttgaatgcctgcgggaggattataagtcaagttatttgttacgatcctgcctgtctttctcggagagcttatcagcgatgaaaaaaatgattttcataactctttcaaatagagaaagccggagtatgagatccggcttcttctgcattatttccccttcgccttcttccgcttttccttctctgcccgataaaactcatgaaacatcttcatcagcgcccgcttttcaatccgcgatacatagctgcgtgagataccgagttctttggcaatctctcgctgcgttttttccttcttcaaatcaagtccaaaccgcccgacaatcacttccttctcacggtcatctaaaatgtcaatgtattgtttcactttttcaagctccatattgagctggatcgtatctatcacgtcttcgttttctgatttcaaaacgtcaatcaggcttatttcattcccttccttatcctgcccgatcggatcgtgaagggagacgtctttttttgtttttttcaatgcgcgcaaatgcatgaggatttcattattcattacaaaaggggggggcataaatttcccgtaacagtttgactaaataaatgttgagtcagtttcctgtaataaatgcttaaacgtttcttagcgaatgaaggggataccttaaataaccaagctacattttcaattgcatgtgattgtatgtacggaagattgatattacgcaacatgcaagttggaatgcaaaagtgatatgtaaaataattggactgccaatccaaataatcagtccaagttgcaggcattgtttttttatcgccttcatgtctatatatatggcaaaattcatgagcaaaatcataccattgttcagttcggctttttcggctgtccaagcatatattataaattccgctgtgtttaagtgcgaagcttgtaacaggtttaaacgacagcctaatatctaaagcctcggcaatccgttcaaaattaatttgttcaggctctgtaatatcaatctttctgtataagttttcaatccaatcctctaaatgactgtttgtatacctcaagatgaaaaacctccttaaagacgacaatctaaaaattggattcgtttaaatattatatggaaattaagacttttttcatagaaaaatgcgtctaaggagatggaatatgaatccgtttaataatgactgttttcgtaagtatgatgattttaacacgcatctggatttctctagaaaagtaaaggtctttagggatttatgtcaaaataatagtaagtaccttatgcaacagggagtttggttgcttaataaggagggggaagtatgaaaaaaaatattcacatattgggagcctctggggtcggaacgtcaacattgggtgctgcattatcaaagcatttgcctcatacgcatcttgataccgatgattactattggttagataaattcactaaaaaaagagaaattcctgaaagacgaaagttgcttgaaaaagacttaacaataaatgagaaatggattctttctggtgcagtgtgtggctggggcgataatctaaaaagttattttgaccttgtcgtcttcttatggattccacaagatatacggcttgagagattaaggcatagggaatttcagcgttatggaaatgaagtgttagccggtggcagtaaatatgaacaatcaaaagcatttttagagtgggcttctttatatgatactgctggaatggaagttagaagtagagctttgcatgaacattggatggcagatttatcttgtccagtgttaaaaattgaaggcgattgcccagtcagcgaaagagttcaccgcgtcttggattatttgaattctaattaaactaacggctagcgattgaaaaagaagaacacggagctgattcacttgctcttgttgagggcaagtgttgacaaccctattgtggtttaattaaagaaggagtataaaacctgtatcaaagatgttactaaatatctacgacacaggttttatatgtaggtaactaatattcttatatttaactttgcatttttttttctgcaatagtcgattctatttctgctttcaatttttcaaaccactctaaattaaccaagtgatgtgaacgggaattttcgttcatacggcgaaagtaatcgattgtgccgggaatttcttgagtgatggacaggtattcatcaaggagctcgattcgagttttagtctgatcgatttgtgattggatcagctccagtaatttatttttatcgaattcatctgcaaagagtaacgccccataaaattgcaggttcacatattccgatttggcgccgtatttgatcattaatttttcgaattctgcccttcccgaatctgtgactttgtagttacggatttcacgcccgctggttgagggtttctgctcaatctgttcaataaaacacttttcttcaagctgctgcagattgtaataaaatgaacctttcgtgaagttaacaatgtatttgtaatgacgcttttccattaaggccagaagttcatagccgtgagctccggggttttggattagcaggccaaggataagtaagggaatcatggtttcatcaccttcgccatccgcgcctcaaattccgcgtacgtgattttacccgaagccaaatccatactatgaaggtaaatctgttctgttttagaatagtcaccattcactttcagcgattgctcctctcccgaaatgggtttcaggatatggtgctttttcgaaaaagcctcgaaatagcggtaaccgaatttgcgttgtgaagctgcgtctaaatgaatgccatcaggattcgcagtcaaacctgctgcagtaacaaaataacaattctgtttttcattagcaaaacgcagcaattgttcattaacctgtcgaaattcagtcgcgtgctgtccaaaaccggtctttccaagaaagtcaccaagccctccaataatcaacggtacctcatcaagttccaactcgtttcttagcgtctcaatgataagagttaatttctcgtaataagtttcatgtagcgaacgataactgtcactctcaccttggtgccaaaggattccacaaatttgactggaccggagggcgaagcgggcttcggacaaagcatgctgaaaaaggatgccttccggatgccagtcattcaatgaactgccaccttcggcacaagggatcaagccaatttcttcatcaggatgagctttcgaccaagcatctgcaaaagatgccgccaggccaacgccggaaaccggacggtcataattaatcggctctgtcatcatctgccactgtccattgcgcagcatttttattttttcattatagatcgggtctacttcattcaaaaatccacggcccgccatattcgactgccccaacattaaaaaagactttatcatctaatttttcacttctttacatcaatattttagtctaattagactatagtcgattcagtttgtcttgtaaagttttaataaggttttacttttattattagtatgtatgaaaaacaaactaacattgaacatttggtggatgtatttgagaaatagcaagttcttttgctatttcttatcccactatcgggggcgattattgaacaaaaactaaaggagtgatacatattagtcatgtataatatgtatcactccatattttttatagctttttttgatttagatcttgatagacaatgaaaaaacaacaaaaaccctgtcatgtaagggttcctatgagcttcaaaatcatttttcataggaaatacgttcaatgatgggggtgtatcccaaatgaaatggattgttaaaaagggaggactatgttgaagaggttaaatatcaataaaaaagtattaaaaaggttaacgattgtaccaattctattcatttgttatgttttatttttaaatcctgaagttatacttgaagagcaatgtcctaataagccttatagtttaacaatcgtaaagcacgggacaggtatatttgataagaaaattgttctaatatattacaaaatcaacggaaaaacagtagctgttggaaatttggtgttttttgagaatttgggaagagatatagatgttacttgggatactaatactgatgatggaacttggtggatagataaaagcgtacatttaacaatgacttatgctaaaaattttgagggagatttagacaagaaagatattgattttgattatggtactgtccaataataatgaagtcaaataggaatatatactaaaagaaccgccagttgcggttcttttgtgtttagatttaaacggatttaagagcactttttttcttttcttgcaagtaccatgattccagaagattatcataagtattgctggtaataagtagaacaaatcaatacataacttgactacttagtagtaaaactcgatgccatgagaaaggttgaagtcctactcatttatgacttatttaaaccaataaacggtcaaccgagagtaaccgattggcaggttgaaatccagtcagttttaaattatcgatatttaaatcacaaacctttgctgatttcttcggagttaacagtcgatgagattttggatatagacgaggctcttggttcacggattcaccagatgtgtcgtgattacatagtgattattaaaggcgatcgaatgcaattaaatcataggtaaggtgattgggaatgaaggaggaaacgaatgtgaaagtaattggtggactttatatatttggaccttcaaatccaactgaaggtaaagatcttacaccaacaatccgtttacttgaggaaaaaataaagcaaatggagcggatgctgagtgcttaaagcagtcgtgtctctgttggcaattttactctccgcaccgagaatagaaaaagaaattgagctatgggaacagcttgacgggaggtaaagaacagttgtattgcattaagttcactgtttatggtgagccagtcgcacaaggacagccgcgtggatcaatacgagaaatgggaaggtgcatatgcgaaatccagcgaaatcaaagtattttaagcagtatgtagctttggttgcgtctcagcatcgaccagaaacaattattactggtcctgtttcaaagtgtacagaccaatgcctaagtcagtttcaaactcaaaaaaaaagaaagagaaagctgaaaatggtcttttgcggcctactacaaagcctgatgttgataactatgtaaagggtgtgaaagtgctttgaatcagttgatatacaaagatgataatcaggtggtggatttgaaagtcagtaagttttatagcgaagagccgagggtggaaatcatgataaaagaggtttctgcctaaaaataaaacacaacgaagcgcttagcctcagtgttctcgatagggaactggtacttctatcaaaacacaggggggacctttgagtgtacaatccaagagaaataaacatcaaaaaagacttaactattcagcagaagattgacccagggagagttcaaatcattgttttatatggaaatcaaggtacagcccatgtctaagatgctccggagcacgggaaaacagtgattcaaactgtaaagggcagttttgcgcgagttgatcatgagataggttacaaaatcaaatagcagtggctttccactgcggggggaggaacggtatggataaattataggaaatttagtgacatccacgaaagatgacagttgagcaggaggcggaatatttgaaagtgcatccggattacatagcgatactcgtgccgaaggtagagaaaaaagatcggtgatgaaacaattattgcaaagtgtgataggacaaacgattggctccttggtgctatcgctgcggttttattatttgcgattgcagtcctgccgggatgggggataaaggcattgcaagaattcgagaagtggcataatttaaaagaaggctggaataaaaaaagggggagctatctccccctatatattagtaacatatattagtaacaacgttcataatttccataccatatcccactccaagaggtaacacctttcagataccacttataaacgccgtcatcatagacgttaggtatttcatttcttgaattataaggaccgaattgttctactatacaagtttttagtgcgtttgcctcggtagttgtgtttgtggtcgaagaagtggttgcaaatgcaggagctgctgaaacaagtaaagcaagtgataaagctgaaccagttaacacttttttcaatttcattttaaacactccctttgtttttttaatacaactgtattatctcatgatatccagaaatatccaagttattttttgttaatgttttgtgaacttagttgaaataaagaaatctgcccgaatgcctgtaccctgaaaagggggcacagcatgggcgatgaggaggtaatattgtccaagacggaaaacctgcggacactgaacttacagcatttacgctgtttgtttggtgttcgttttttatttgaaaaagggggatacaatcatgaatcaaaaagaaattgaaactctaatcactggatggtgaaagaggttcgtcgtttgcaaaaggtactctatggttcagtaattcccatgaagaattggagtgttgcacaatatggattagaatcagctatgccaaaaggaagtcccgggaagagtcaggcagaattgcggcaaatggaatgagagaggaacgtcttttcaaacgtcttaagtattatgaagaacgagtctatgcggttgagttgggggcagaaaagatcaaaggggagcagcacaaagttatttatgattgcatgatggaggggatgagttatcgtgcaataggtcttcatcttggcatttcaagggaaactgtacgcaaaatgaaagatgagttcatcagccatttatgccaagattgccactttgagcgcttgttgaatctgaaaaaatctgtagtgtaaaatgggaggcaggatcggcgcggcggattattcctgcgtcaccactacattcatggaatgagaaaaccccccagcgataagcgaggatcaactcaactgggaggttttatacagttaattcgggtgataaaacaccagcagtattgcgtaaaaattaatattcccgacaaaaacaaaataaagcctcatgtttgatgatgataagggttgaatgtgctctatcaaacgaggcttttagagcgaattcactaataacgggtgcattcgttcgtaggaggattatttccaagaaaaatgggttctattcatattgaagagcgcttttcataataaaaccccacgttgatcataaagagttggagaaacgtggggcagagcgatgggatatttatgtggagagttgctctaataagtaatctatacagcttttgttgtgatgtgcatgattttgtttgataaatcctcatggagcagtaaataaggtggttgtaatagtactattagatgcttctgaacatagtttataacagataaaaaataatgaagggagaagaaaatatgcatcattgcaaaattttacctccaattgtgcatccgactaagtgttgtgaacatcatacgttctcaaatacaattgttcctcacattcatccgcagcatacaactagcgtgaatcatcaacattatgagcatgttcattactttccgcatagttactcaagttacgatcctgtcactgagcatcataagtattgcggaaaaccttgttgttagggatttccgaaaacaattaattaaaagagaggttttaaagtggcctctctttttattgtctctcctattttggcaatttaagagcgttgttaataacatagcaaaacgccataaaaacttcttatggcgtcttcgtacagggaggtgaaatccaaaaggccgctttggattaaagtgccaaagactaataaaggaatgcagcaccaacaatgattaatagaatgaatagcactacgattaatgcgaaggtgctaccataaccatttgtgtttcccatatagttacctcctttaatagtagattaaaatatttcaagactaataaaggaatgaagcacccacaatgattaacaggatgaacaacaccacaactaacacgaaggagctattgtaaccatttgacatgttatcacctcttttagtggagttagtataagatatgtcaaacaataattttcgacatagatttaagtctaaataagagaaaatgaatattttgtctaaaggtgtaatagcagatacatcagcaaaaactattaaaacaaacacaaactcaaacatgaggtccggaggtgggtaagatgtaatgccaagaccacgagatccacgcagagacaaagcttttcgtttttgggaagagagcggcgggagtaagaagttaaaagacattgctgagcaattaaacgtaacaagtagcactgtccgaaaatggaaaacaaacgataaatgggaagaaaaaataaaagggagcgctcttttgcgtcgaggcgcacctaaagggaacaaaaatgcaaaaggaaataagggaggaagagcaccgcttggaaataaaaatgcattaggaaataaaggtggtgcagctccactgagaaatcaaaacgctgtgactcatggattcttctctaagttcctgccagaagaaacgctatccatcatggaaggtattcaagaacgtttgcctgtcgatatgatatgggatcagatacagatccaatatgccgcaattataagggcgcaaaaaaacatgttcgtttctgataagcaagaaatgattaaggaactaaaaaagaaaaagtctgtcctatctgagacaaacgaagtcgaagaggaagaatacgaattccaattttcttgggatcgtcatgcaacgttcttgaacgctcaatctagggcaatggcagagctcaggaactttattaaacagtttgatgtagcccactcggaagacgaacgacgccttaaattggagaatatgcgtttaaatatcaacaagaaaaaattagtgatcgaaaaacttacagaagaagacaaaccttttgagatcaccattgtaaacaagagtgatgacaaatgattaaacaagtaaatcctcattttaaagaatttctctttgactggaatcaaaagtttcagtttcttgtgggtggttatggatcatccaaaagctatcatgtggcactcaaaattgttctgaaattgcttaaagaaaaacgaactgcacttgttatcagagaggtgtacgacacacatagggatattttacctacgtgcgtcaggaagctgtcgctaatgaagaattgtcaataactgaaaatttagcgcagatcggtgttaaaatcccatcatcaataacagatcgattacaaacgattgagaacgaaaaagaacagagtaagaataacgcagacaaagctgctggctaagccagtggcttttttattacacagacagaaggagagaggatatatagccattaaagttgtaaagaatttagtctctaaatcaaagtatggattgaaatgtcctaatccaatgaaagctgaatatatcactattcataacactgcaaatgatgcttcagcagccaatgagatttcttacatgaagaataactctagctcaacgagttttcactttgcagtagacgataaacaagtcattcaagggattccaacgaatcgtaacgcttggcacacaggagatggaacaaacggtacagggtatcgtaagtcgattggtgtcgaaatttgttatagcaagtcaggaggggaacgatataaggcagcggaaaagctcgctattaagtttgtggcgcggctactgaaagaacgcggatggggtgttgatcgtgtccgtaagcactaagactggaacggcaagtattgcccgcaccgtattttgtcagagggaagatggaatcaagttaaggctgctattgaaaaagaattaaagtcgctaggtgggaaaataagtacaagcaaaacaagtacagctaaaaagaaaacaacaagctcaagtagcaagaaaacgtcatatacgctgccttccggcatctataaagtgacaagcccgatgagaaaaggggacgacgtaaggcaaattcaaaaagcactggctgcactatacttctacccggataaaggagctaagaataatggaattgacggtgtgtatggcccaaaaacagcagatgccgtaagacggttccagctgatgaatggactaaatcctgatggcatttatggaccgaaaacgaaagcaaaaattaaagggcttttatggattataaagtttcaatattcttttctattttttgaataacttgttcgacccatactaatggagatactccgtaactacgaatgtctactccgtcagcagcttcatcgataaaatcattcttttcttcatccgtataatcactgttaataaaatcttttaatgctactatatcagtttcttgctcttcttttggaatctcttctaagtattcgtccagtgctgattctggagtttctatatcttgatgaaaaatacctcctagaaattgaaaaacaggttcggaaatgtttgtatctatcatggtatcacctcgttgggtagccagttaatataaagctaccatctttgttctttttcaatataattttagcattagttaaatcagtaattgtatcttctccctttggtattcctcttcctaaaacttcattccctttataagagagtactaaaggctttttcacatcactatttaaccatttttctattttcgctttattatttgtgagagcactattagcaactctttctgcagttgctctatctttaaatgatgatgaaccggatatcttcttgttactcattttgctcttatcaagtctttgaattagttcttcgtcggtcttcccaacatgtctttctataagatgcccgccttttgcctcatgagcagctaatcctccaccaggtgcgagaggggtactatcaccttgtttgacattacctatacccatgttgttagacgtctcggattttctaagtacactctcttttttatcttcaataatcctttttaataaaggcgtattctttatcataccctttcatttaatcatatatcaaaatattaccatgggagaaagaagaaacgaacctaaaattaacttgattgatcgtatcaaagatagcgaataaaaagtttgcggtttttttgcggtccgaacactttttggaaatgttagaatattacataaaaagacataaaaggaggggtcctgtgaatccggttttatcatcgtcagaagttggcgtaaagatcaatgaatggtataaaatgatacgtcaatttagtgtcccggatgcagagattttaaaggcagaggtcgagcaagaaatccaacggatggaggaagatgagtatttactcatttacttctccttaatgaaattccgtcatcagctcatgttagattatttggaacccgtaacgacacgtataagaccaactattgatgagttacttgaaaaaatagaagcatccaacaaggggataactggcctgttgtcttactattctctgttttttcgtggaatgtatgagtttgataaaagggaatatgtcaaagcgataggtttttatcgagaagcagaaaaacatcttactcatgttaatgatgatattgagaaggcggaatttcattttaagttggctgaagcttactatattatgaagcaaaatcatatctcgatgcaccatgttaaacaggcgatggacatttataatcaatatgaactttataaagtgcgaaaaatacaatgtcatttcgtgatatctggaaattacgttgattttaaacatttcgagaaaagcttgccgcaccttgaaaaagccttagagttgtccaaacaattagatcgcaatgaaaggctacttagctcggcttactacaatctcggaaagaattacgcagatttaggaataaatgataaagcagatcatttcttaaatgaggctgccaaggtatcagaaagtgctaagttgagcaatttaccacattccttgtttacatacgctaaatttctttttaagcaggggaaaacaagtgaagcaataaaaatgagtaaaaagggtttatccgctgcaatatcccaaggtgataaactttttgtgtccttgcaaaagtatttggaagcactttatattaatgcagtagatcaagtgggtatcaaaaaaacgattgattacttagaaagaaataagaattatgcgtatgtggaagatatcgcaattgatacggctgaagtttttgcaaaatcaaaggaatttgaaacatcatatgtttatcatcaaaaaatgcttgaaacgcaaaaacaaattcagaggggagaatgcctgtatgaattttaaaaagggcgtaatcattactcttactgtagttactttaagtttaggactcgttactaattttactgtagagcacagtgaagcatatcatcaactttctgaccgaaatcagacatgaaaactgataggtataataaccttatttttgcggagagaaaaaggcaatagggcaccgcaatttaaattttcgatgagaccgcaataactttttagcttcgtattaaggagcttgattatatgctagataacggagaaagtgacagacaggttgggctgtcaaagaaaacaccagaatatgcagaagcaaaaggtaaagcaactaagttagaggagtaaaccatgtgtttgctcctcttttttctgtttataaaaggattgttgcggaatcgtcatcaagtcgcaaaattgttggtgactattggggagtatttcaaacatttattttaaaaatcgtttcgaagaaaggaaaaaagagagtgaaaaaatggttcacctctttatatcgataataaataaaccagataaataggaaaaaagaattcaatacaaaagaaaaagtttattttatagactgttaggcatatataaaaacaggaaaactgtctgatgtaagaaggtagttttaggtttaatatagttaatgcccaaaaaatggagatttataatgggtaatgtaatatctcgaaggaaaactctcttaatttaaaactgaaaggagaatcataaactactaggagaaagatagattaaattgttagtgaattaatcttaagagaattaatgattagtaatcctaaaaacaaagaagatggagaatatgtatgtttaaaaaaattagtatttttatattactttcttcaataatcatttcagctttttcacagacagcatctgctcatacagtcaaccctgtgaatcctaatgctcaggcgacaacgaaagagttgatgaattggctagctcatctgccaaaccgatctgaaaatcgcatactgtcaggtgcattcggcggattcacaaatgcttcgttttccatgaaagaagccaaccgaattaagaatgctacaggccagttacccgcaatttatggttgtgactattccagtggatggttggagaagccctatatttctgatattactgagacgatcgactatagttgcaacagtgacttaatctcatattggaaaagtggtggaataccacagattagcttacatctagctaatcctgcatccagtacttttgggaaaaatgcttcccatatttcaaacagtgagtatgaaaaaatcttagactcatcaacaacagagggtaagcgattagaggctgttctgagcaaagttgcagatggccttgatcagttaaaaaatgaaggtgtacctgttctattcagacctcttcatgaaatgaatggagaatggttttggtggggactaaccgaatataacaaaaaagacagccagcgcatctcactttacaaacaactttatcaaaaaatctatcattatatgactgatacaagaggtttggacaacctgatttgggtatatgcaccagacgctaacagagactttaagatagatttttatcctggctcatcatatgttgacattgtgggattagatgcatatttctcagatgcttattcgattaaaggatatgacgagttaacggctctggataagccatttgcttttacagaagttggtccgcaaacaaaaaatggcagcctggattattcacaatttatcaatgcagttaaacaaaaataccctaaaaccatctatttcttagcttgggatgaggattggagccctgtggctaatcaaggtgcctctaatctctataatgacagttggacactgaataagggcgaagtgtggagtggtagttcacttacaccaatagttgaataactgaaatgacaaaggacataaacaatttcttcatgtcgttgagtaacacttgctgaatttcttacagaaaaattcatctcatcatagaagaaattgacgttatggtttccaaaagaagatactagacgttgtgcaaagaaaaacgttaaggagcagacatgagtttgctcctctttttttgtttataaaaggattgtcgtgatgttgatgaattttcggtgagaccgcaataactttttggtttcaatgaaaaatttacaggcagggaattaagtggttttgagggttacttaataaaaaactccttcttagatgaagatcaaatggtggtttcaaaatagctgcagatcgagtttgtgcataaagaggaagggtattgtaccttcctttattatatgatgtatttttgaagacctgcttataccttgaactcaaaatgattgactttaaatgcttgactttaaatgcttgaaataacagacatttgtaactgaatatacactcccactttatagagacctagtgggtttagtaaaaactctagaaaacaacgatggtttcaaactatcgttgtttttatttgttttcaactcttaaaaatcacctcattaggacaaacagttattacatagcattacccaaggggtgatgcattttatgaaggtaataatcatcgagggaccgcaagctgacaaatgcattaacgattgctatcattatttaataaaactttataggaaggagatccagggtgatagcaatatatgtaagggtatcgaccgaggagcaagcgatcaagggatcgagcatcgacagccagatcgaggcctgtataaagaaagcagggactaaggatgtgctgaagtatgccgatgaaggattttcaggagagcttttagaacgtccggctttgaatcgcttgagggaggatgcgagtaaaggacttataagtcaagttatttgttacgatcctgaccgtctttctcggaaattaatgaatcagcttatcattgatgatgaactccgaaagcgaaatatacccttgatttttgttaatggagaatacgccaattctccagagggtcaattgtttttcgcaatgcggggggcaatctcagaatttgaaaaagccaaaatcaaagaacggacatcaagcggccgacttcaaaaaatgaaaaaaggcatgatcattaaagattccaagctatatggctataaatttgttaaagagaaaagaactcttgagatatttgaagaggaagcaaaaattattcggatgattttcaattacttcaccgatcataaaagcccttttttcggcagagtaaatggtattgctctacatttaactcagatgggggttaaaacaaaaaaaggcgccaaagtatggcacaggcaggttgttagacagatattaatgaactcttcttataagggtgaacataagcagtataaatatgatacagagggttcctatgtttcaaaacaggcaggaaacaaatctataattaaaataagacctgaagcagagcaaatcactgtttcaattccagcaataatcccagccgaacaatgggattatgctcaagaactcttaggtcaaagtaaaagaaaacacttgagtatcagccctcacaattacttgttatcgggtttggttagatgcggaaaatgcggaaataccatgacagggaagaaaagaaaatcacatggtaaagactactatgtatatacttgccggaaaaattattctggcgcaaaggatcgcggctgcggaaaagaaatgtctgagaataaattgaaccggcatgtatgggatgaaatttttaaattcatcacaaatccccaaaagtatgcttcttttaaagagattgaacaatcaaatcacctgtctgatgaattagaactcattcaaaaagagatagagaaaacaaaaaaaggccgcaagcgtcttttaacgctaatcagcctaagcgatgacgatgatttagatattgatgaaatcaaagcacaaattattgagctgcaaaaaaaacaaaaccagcttactgaaaagtgtaacgaaattcaatcaaaaatgaaagtcctggatgatacaagctcaagtgaaaatgctctaaaaagagctatagactattttcaatcaatcggtgcagataatttaacccttgatgataaaaaaacaattgttaactttatcgtgaaagaagttaccgttgtggattctgacactatatatattgaaacgtattaaagagggttattgccctctttttgtaattgaaacctctgaagtagatccagacatcgaagaaaacagatagccaatcaaattagtaagcgcctttctaaatgggcttatgaaactggtgcacattacatgtatcaacatttatccaaacaaaccattcggcagtcgagtattcaagtgcagatttctttattgtggatgctttttatgtgtgagaaatagacttgggatgaagattatcgcaaggacaatggcggatactaagaatccggcatggtaaccttttaagtcattcgcaatcgttggttgcaatccttgtatagtagttgcgacaacagttgcgataacagctgaaccaaaacttgaaccaaggttttcaataatattaataccgacacctgcttctggaagttgtttgctgtcaagtcctgtataagcatcacttgttaacggaagcataattcctccaaaactggtcccgcggatgaataatatgatagaaatccacatcatacttgttttatcggtgataaagataagcggaatagatccgataagcgaaagaacaagactgaccataaccacgtattttgcaccgatcttatcaatcatttttccaatcattggccgagtaacgagcatcccaactccttgagggattaatgcaagcgcagcttcgattgccgtgaaatgacggaagttttgaaagaacaatggaagtattaacatgggtcccatgacggcaatattcgctaataataacccgacgctggatgttaagaagtttttgtgtgcaaacaaatttatagggagtacggtttgattttttctgattcgattatatacgatgtaaattaaagctaaagcgaggccgaagcccacccataggattgtttcgctattgttaaatgatgcatggtctgctgcttttgtaattccgtatatcattgctgcactcattaaggatagattgataattccaaaaatatcaagtttactatttttgttgaatggctcaaagtctggaagagttttcatcatcagtggtgcagcaatcaaaacgatgaacacgttgatgaagaaaatccaatgccatgatgtagcttgaacgatgaagcccccgattacaggtcctaagattgggcccaaaatcataggtgtgctgacgatagccataacttttcctatattctctggacctgctgttttaaccaagagtgttgacataagtggagtaataatcccagcgctaaatccttgaagcatacggaataagataaagctagaaacatcccaactaattccagcaaaaacagaagttacaccaaaggcaatgactgcgccgattaagattttctttccattaaatttgttcataagccatccggatactggaactgcaatagcaagagctaaaacataacctgtaatggaccattgaatggtatccaacgtcgtactgaaatccttatttaatttgtcgatggcaatgttcaccatagttgagtcaagcattggggcaattgctccaagtgcaatagcccaggcagccatgaggatttcttttggtaatcctggttcctttactttgccttttaacatattattctcctctcaaaagttgtatttttgtttcctggtcaacaaaaaataacataattttgtttccgcgtcaacaaaataacggtaataaaaaggcagccgaaactcaatagagttggctgcctgtggttacattttcattatttaaatttattccgacttaatatcaacaccatgtttttttatttctgcatccaaatgtctattatacttttccgcaaagttaatcataaaatcaaattgttcctcggttacctgttcaaatactgccttatcacgctctagaaactctttatgcagtttatcatggattttataaatttctttcccttgctcggtaagcctaaaatgaatttctttcttgttatctggcttctggtagctctcgattaagcctttttctatgagctttttagtcattttactaatggcgcccctcgtcatataaagggactcagcaagttttgtcacattagtatttccatgttcaatggattctatacaatgtacttcagaaggcttataccctttaagacagacttccatctttggcttattaagccaagccatcttgttaaacaagtccctgaaattcattaggagcagttcttttttgttcatggcgagtcctcccacccgttggtgcatcagcaatagtgtaatggatttttgtttccgtttcaataataaaccaagagaggagaagagatcaccgaatatatttaaacgtattaaagaggagtatgcaccccccttttgtaattacaatctcattttcaatacacctcgcagcatacgtcgccagctttgtccctttaccagcggaatagctttcaattccttttatcagcccgatcgttccgatggagattaagtcctctgcatcctcacctgtattttcaaattttttcacaatatgggcgaccaagcgaagattatgctcaatcagcatgtttctggcatgttcatcccctttagccatgagctctaagtattttttttcttcgctgcttgagagcggttgtggaaaggcattgtttttcacgtaagatactaaaaagacaagctctttaacaacaaagccgagcgctgcgaaaacacctgtcaccatcgtcacctccacaaaagtatgtaggcaaaagcctatatgtaaatgtatgtgaccgggaggctgtctgtgtctgtaccgggaaatttctcgcgggggagtccggctttggtaagcagcatactaacttcaaatgttaaaaatattcttcatcaagcgcccatacattgaaatgaacaaaggtatggggggatgggaatgaaaaaatggatggcaggcctgtttcttgctgcagcagttcttctttgtttaatggttccgcaacagatccaaggcgcatcttcgtatgacaaagtgttatattttccgctgtctcgttatccggaaaccggcagtcatattagggatgcgattgcagagggacatccagatatttgtaccattgacagagatggagcagacaaaaggcgggaggaatctttaaagggaatcccgaccaagccgggctatgaccgggatgagtggccgatggcggtctgcgaggaaggcggtgcaggggctgatgtccgatatgtgacgccttctgataatcgcggcgccggctcgtgggtagggaatcaaatgagcagctaccctgacggcaccagagtgctgtttattgtgcagtaataaagaagaggctctttcttgagcctctgttgttacaatccttcgccgagctgaattttcgggggataggtttctgcttttcgccaatattggcgtgtgccttcgtcccgtacaacgatgcccagctgtgccagttcgagacggaattcttcaatatcgtctttttcttcgtcctgcagtgctttgtgacgagcttttaataaggcatgggcgccttgcgataggtctggtgcatcaggaatccatcggcgaaattgatctttaaacggatcaccatctgttgcccattcgtaatgatgctgtctaaaggccttctcaacgtttactggtttttcatcaatttcttcccgtaccaattcatatccggctgttcccaggaggacaagccgtttgtgatccataaatacaagagcgatgtcatcggaatgaattgtttgcactttttttcctttgatgaattccactgtgtgatctgtaattttgacagacagcagcattgcaataacagaatgagcgaaccaaatccccgcacacataccgagaagagcagtgataaatgaagctgtagatccctgaaaagaggtaatgagccgaagtggtccttcaagagggatccaggggagggataatgcccatttcgcaatctgcggaataaaatacccgattgcaaaaccgatgattgcaagtgcagcgtataaaaagaatacagcggttttcgtaactccgataagagtatgagattgattctgcaacatgtcaccttctttttactaaaaaaatcgaataccttcccatattttaacttaaactgatggtaaatcaaggataaagtgataattatggatataaagagattcagtaatagaactggcaggcacagtcagtcatgaaaaataaaatttacatgcgcagacgatgtaagccccatttgttttctgcgtatcacaatacaatccaaagggaacataaagagtaaaggctttttagacaatcaggaggaacagatatgaaaattggattaatcggcttagggaaaatgggcataaacataggaaagcaattcattgaccgcaatcatcaagcggttggatatgatgtaaatcaagcggctgttgatgaactgaaagcatacggggctgaggggacaacgaatcttaaagagttaatttctttattagactcgccgcgtatcctatgggttatggtaccgcatggcattgtcgatgctgttttgcgtgatgtatcacctttattaagtaaaggcgatatgattatcgaagctggaaactctcattataaagaatcaattcgccgctacaatcaaatgaaagaagcgggtatccattatctcgatgccggaacgtcgggcggaatggaaggcgcacggcatggagcctgttttatggtggggggcgatcatgaagcatgggagattgtggaaccgctttttcgtgatactgccgtcgaaaatggttatctatacgctggtgaagcgggaagcggacattttttaaaaatgatccataatggaattgagtatggaatgatggccgcgattggtgaaggattcgaagtgcttgaaaacagccaatttgattttgactacgagaaggttgccagagtgtggaatcatggttctgtcattcgttcttggcttatgggactgactgagcgagctttcgctaaggatgcgaaactggatcagatcaagggcattatgcattcctcaggtgaaggaaaatggacggtggaaaccgcgcttgatctgcagacggcaactccggtcatcgccatgtcactgatgatgagataccgttctttaacagacgatacgtttacaggaaaggtggtcgctgcgcttcgaaatgaatttggaggccatgcgacagaaaaaaagtaagggggccaacaagcctccttatttttttggcaccttcagaagatgagggaactttttataaatgaccagcatgatgatcagaatatatgcaccgtaaatgctgatagacaataatttattgctggtgaaattggcacctgcaatagtgacaacaacaatattggggattttccctattaaagacgcaaagaaaaaaacatgccagcgaacctggctcagcccgcagatcacgttcattacaagtgaaggtatgacaggtatcagccttcctaataaaacagcggtaaaagcgtttttgttgaaggaagcctcgtagctttgtatggcaggataggcctgaactttttttctggcccaatctctaaaactgtacctggcgagaaaaaacagcaatattgtaccaagcattgagccggtcagtgtaatccaaattccatttgcagtcccgaacactgcgccatttaaagcagcaaccaaagcaaacggcactattgggaaaaaaacatcggcagcaatcagcagcatactaaataaaacggaaaacatccctcctgctttgattgcatcaagccaagcttctttctgaaaaaaaccgactgcaatgatagcgataatcacaagtatacctattactttttttaacatgtctatggtcactcccaacttaggtgatgtcaggagccaaaacctccgtcatctaaattagtataactggtgccatttcagcggttcaactgaaaaccaggttgagaacacaattcttttttacctcataaaaaaggctgtccatctctctgttttctgcattcttaataatagggagggatagaaatggtaaccataaaaaaggattttataccggtatcaaatgataatcgtcctggctatgcgatgacgcctgcttatattacggtgcataatacagcgaatacagcaaaaggcgctgatgcgaaaatgcacgccaattttgtaaaaaacccgagcacatccgaaagctggcattttacagttgacgattcagtcatttatcagcatctcccgatagatgaaaacggctggcatgcgggagacggtacaaacgggacaggaaaccgcaaatcgatcgggattgaaatctgcgaaaatgctgatggcgattttgaaaaagcaacatcaaatgcccagtggctgatcagaaagctgatgaaggaaaacaatattccgttacatcgtgttgttccccacaaaaaatggtctgggaaagaatgtccgcggaaactcttgaaccactggaactcttttataaacggaatttcttcctcggatacacctccaaaagaacctttaccatcatatcctctgccgtctggggttataaagctcacttcgccttatcgaaagggcacaaacattctccagctgcaaaaggctttagctgcacttcacttttaccctgataagggagccaaaaacaatggcatagatggagtttacggaccgaaaacagcgaatgtcgtcaagcgttttcagctcatgaacggattaactgcagacgggatttatgggccaaaaacaaaggccaagcttaaatcgaagttaaagtaaatgcaggatttaacggataacctgtttccagtgcggattcaggttattttcttttctttggtttgtgtgtttttcagattggaaagaagggaattttaaaaaatcatcagctgcgccgcaatgaaagcagaatgatattcactgagggggacacgttaactataggaaaaaacagtgatagcgaaaaactcttcattgaacgaagagaaacagaggtataacattaaggtgaggcttttgggggtgtaaagatgaaacattttatcatccttttccttctgctgtttgttacagcaggatgcgagggaaggggatacgaagacgttgtagcatttggtgacagcaatacgcgtggctctaattgggattatcgcgattatccaaaagcacagcagtgggtcaatatattaaaaacagctgagcgcggtaaccttgatatactcaatgcgggaatcggcggacagacgacagaggatgcccgtctccgatttcagacagatgtgctggatcaaaaaccgaagtatttgtttattatgttcggcaccaatgacgctgccatactgactgaggggaaaccgagagtgtcgaagcagcgttttagagaaaatctggtttattttattgaagaaagcagaaaacacgggatcaagccaatcttaatgacgtgtatcccaattatagaaggtaatgggaagcatcatttgttttactattccagatatcaagcagctgcttttgaaccaaaaggcggagcaaggaaatggcacaactcatataacgatattacaagagatgtgtcgaagcgcctggatgtccctcttgtagataactggaagcattttatagaagcagacggcggaaaagcaactgatgaagcgcttatccaatctggtcttatagatccttctggaaatcatatgacacctaaaggggcaaggatcgtatatgaaggaatacaagatgggcagatcctgcagcgttgagccggacaaccgcctagtccgatttatttctcctacataggctgttataaaaccttattaaggaggcgcttcacatgtatggcgcaggcagagcatatggatacgcttttattgttgttttagttgttgttctccttgttgtgggcggcatatactggttagcataataaccggccctttaaaacacctctttttaggggtgttttttgccgaaaatagtagtaaagcgcgcagccaaagtgatataatatcagtcatctgagtaaaaaaaggaaatacgcccggaaaaaatagacaaattcctattaagaagatacggaaataatatgtccgagcgatcttctttttatttcgttttcaattaactcgataaagtcacggtttaaattcatttcggtggctttgaaataagattctattagtaattcatcagacagttttctcatgctaggaacccaattaatgggagaggcacctccttaaaagttggaatcattcatgattttaacgcatacaatgataagttgcgttcatctgaggttgaagttatctttaatctaccatgaaatgcatataagaacaatcgttctgttatccacaccaaaaagtggataacttgtgagtatcgtgtttataatttgtctaaagagtgatgtaataagagtggatagtgtgtgtaaatttatccacacctggtgaagaaacccaatttttgtcgaaatttttttgctcagtttttctttaggcgcaagttcgatttttttcgacaatcattttgaaagaaagaaaaagggaagggtgcgggttttgttaaaaaagttttttttacctgacgagtttgtaaaaaatatttttcatattacacctgagaaattaaaggaacgaaatgtaaaagggattattactgacctggataatacgcttgttgaatgggacaggccgaacgcgacgccgcgattgatcgagtggtttgaagaaatgaaggaacacggcattaaagtgacaattgtctctaataataacgaaagaagagtgaaacttttctcagaaccgcttggaatcccattcatctataaagcaagaaaaccgatgggtaaagcctttaatagagcggtgcgtaatatggagctaaaaaaagaggactgcgttgtcattggagaccagctgctgaccgatgtactcgggggaaaccgaaacggctaccatacgattttggtcgtgccagtcgcttcctctgacggattcattacgcgctttaaccgccaggtcgaacgcagaatactgagtgctctcaaacgaaaagggcacattcagtgggaggagtaagaaatggaaaaggttgtttgtatcgggtgcggagttacgatccaaaccgaggacaaaacaggtttggggtacgcgccgcctgcatcgcttacgaaagaaaatgtgatttgccagcgttgcttcagactgaaaaactataatgaaatacaagatgtctccttaactgatgatgattttttgaacattcttcacggtattggagaaacggactctcttgtcgtaaaaattgttgatatttttgattttaacggcagctggattaatgggctgcagcgcttggtggggggaaaccctatcttattagttggcaataaagcggatattttgcctaagtcactgaaaagagagcgtctgatccaatggatgaagcgtgaagcgaaagagcttggcttaaaaccggttgacgtatttttggtcagtgcgggacgcggccagggaatcagagaagtaattgacgcgattgagcattaccgcaacggaaaagacgtctatgttgtcggatgtacaaatgtaggaaagtcaacctttattaaccggattattaaagaagtgtcaggtgaagaagatattattacaacatcccaatttcctggcacaacccttgatgcgattgaaatcccgctggatgacggttcatcgctttatgatacaccgggaattatcaacaaccatcaaatggcgcattatgtcaataaaaaggatctgaaaatattatctcctaaaaaggagctgaagcctcgcacattccagcttaatgatcagcaaacactgtattttggcggacttgcaaggtttgattatgtgtctggggaaagatctccttttatttgctatatgccgaatgagctgatgattcatagaacaaaacttgaaaatgcagacgcgctttatgaaaagcatgcaggggaattgctcacacctccgggtaaagatgaaatggatgagtttcctgaattggtcgcccatacgtttacgataaaagacaaaaagacagatatcgttttctctgggttaggctgggttactgtccatgacgccgataaaaaggtaactgcatacgcgccaaaaggcgttcatgtatttgttcggcgttcattaatttaagaaaaggggagaggagtatgaaaaagctgtacggggttatcggaaatccgattggccattctatgtcacctgatattcataacgcatcattgaaagacctcgggcttgacggacattatcatgccttcaaggtagaagagaatgatctggaggatgcggtaaaaggaataagagctctaggcgtacaaggaatcaatgtgactgttccgcacaaggtttccattatggattatctggatcatattgatgagagtgcaaaagtgctcggtgccgtaaacacggtcagaagagagggagataagcttgtcggatacaataccgatggggaaggcttcgtgaagtcattaatgaaggtattagacaagcccatctctgaactgtcattcttaatgatcggcgctggcggagcggcgagagccatttttacaacaattgtccgaaataccccgaaaaaatttgacatttgcaaccggacgttagaaaaagcaaagcggcttacagaagctactccctcgtttcacaataaagaagtattaagcataaaagaagcagaagaacgtcttgagcagtatgatgttatcatccatacaacgtctgtgggcatgtatccgaacgtggacgatgtgccgctttcattacagcgtgccgcgagcagtgccgtcgtatgtgatatcgtgtataatccaatacagacggcccttttaaaggaagcaagccaaaaaggcttgaaaacactcgacggtgtgggcatgtttgttgaacaggcagcattgtctttccaattgtggactggacaagagcctgatattgaaaaaatgagatccattgtaacaggaaaattaggaggaacagaatgttaacaggtaaacaaaaacgttttttgcgttcaaaagcgcatcatttaacgccgatttttcaagtaggtaaaggcggagtaaacgacaacatgattaaacaaattgctgaggcgcttgaagcgagagagctgattaaagtcagcgtgcttcagaattgcgaagaggataaaaacgatgtagcggaagctcttgtaaaaggaagccgctctcaattggtgcagacaatcggcaatacgattgtgttatataaggaatcaaaggaaaataaacaaatcgagcttccttaaaggtggttgaaatgaagaaaatcggaattttcggaggcacgtttgaccctccgcataatggtcacctcttaatggctaatgaggtgctgtaccaggcggggcttgatgaaatttggtttatgcctaatcaaattccgccgcataaacagaacgaagactataccgacagctttcatcgcgtggaaatgctaaagcttgcaattcaatctaatccgtcctttaagctggagcttgttgaaatggaaagagaagggccatcatatacctttgataccgtttctttactgaagcagcgttatccaaatgatcagctgttctttattatcggcgctgatatgattgaatatttgccgaaatggtataagctggacgagctgctgaacctcattcaatttattggagtaaagcgccccggttttcatgttgaaaccccttatccgcttctctttgcagacgttccggaatttgaggtatcatcaactatgataagggaacggtttaaaagcaagaagcccactgactacttaatccctgataaagtgaagaagtatgtagaggagaatggtttatatgaatcgtgaggaggcacttgcatgcgtgaagcagcaattgaccgaacaccgatatatccatacggttggcgtgatgaacacggcgatcgaacttgcggagcgttttggagccgattctaaaaaagcggaaacagcggcaatctttcatgattacgccaaattccgcccgaaagaagaaatgaaacaaattattgcgcgtgaaaaaatgcctgcgcatttattggatcataatccggagctctggcacgctccggtcggcgcttatttggtccaaagagaggcagggcttcaagatgaagacattcttgacgccattaggtatcatacctcaggccgccccggcatgacacttttagaaaaagtcatttacgttgccgattacattgagccaaaccgggcatttcccggtgtcgatgaggtgcgtaagcttgctgagacagatttgaatcaagcgctgattcagtccattaaaaatacaatggtttttcttatgaaaaaaaatcaaccggtttttccagacacatttttaacgtataactggcttgtgtctggcagctgaacaggaggaatttgtgaatgaaccataagtccattttaaagatcgcagctgcggcttgcgatgataaacgggcagaggatattttagcactggatatggaaggtatttctctggttgctgattattttctgatctgccacggaaattcagataaacaggtacaggcgattgcccgtgaaatcaaggatcaagctgatgaaaacggcattcaagtcaaaaagatggaaggctttgatgaagcaagatgggttctcgttgacctaggcgatgtgattgtccatgtcttccacaaggacgaaagaagctactacaaccttgaaaagctgtggggagacgctccgctcgcagatcttgatcttggaatgaatcaatgatttatcaaggctttgcaagcgtgtatgacgagttaatgtcacacgcgccttacgatcaatggacacaatggattgaagcatctctcccggaaaaaggccgtattctcgatctggcatgcggcacgggggaaatctccatccggcttgccgaaaaaggcttcgaggttacaggcatcgatctcagcgaagagatgctttctttcgcccagcaaaaggtatcgagtagccagcctattttatttcttcagcaggatatgagagagattaccggctttgacggtcagtttgacgctgttgtgatatgctgtgactcattaaattatttaaaaacaaaaaatgatgtgatcgaaacctttaaaagtgtatttcgggtattaaagcctgaaggcattttgctgtttgatgttcattcatcttataaaattgcggaagtctttccggatagcacatttgctgaccaggacgaagatatcagctatatttggcagagctttgccggaagtggcgagctttctgtcattcatgatatgtcgttttttgtgtggaacggagaagcgtatgatcgttttgatgagacacacgagcaaagaacgttcccggtggaagaatacgaagaaatgcttaagagctgcggctttcagctccatcgcgtgacagctgattttacggataccgagccatcagcacaatcagaacgcctctttttcaaggcgcagaaatcaaaaaccatcgtttcctaaaacgatggttttttaaaatgcttttttatgcttttgcagtacagacgaacgtatgacatactcgtctacacatgaaactgctttttcactgcggaaatatcctcctcgtacttcatatgagtattttgaaatacccggtgaaacatatcctgcacaccgctttccagcgctttaatgccttctcctgttacaccgcctttaacgcaaaccttttcctgtaatgcaggcagggtatacaattcggtttctaacagttttcccattccgacaagcatttccttacacatcaaaatcgcgtcctgtttagacactgatgtttccgaaacagctgcatctataaaccgctgaatcagatagctcataaaagcggggccgcagcttacgatgtctgatgcaaccctggtgatgtcactttcaatttgcaggggatgagagatatgctgcatcagctcattgattttcgtttttgcagattcgccgcagcttgtgccgaaagtgacgagagaaacacctgccagcgctctgttcgtaatacttgggatcactcgagccacttgacacggcacatattgttcgagctgttcggtttgaacggggcttgtaattgagatgagaatatgatcttttcttaaataaggtaacgctcttgccagtaaaggatatatatcaagcggcttaacacaaataaaaatcatctcgttttcagaaacgagcttttcgagactttcggtaacgtttatgctgttgtagcggttttttatgtgcaacgctttttcaattgtgcggtttgtgattgtcatgtttgagggatcggctgcttttgattcaataaatgattcgataaggatcgtacccatatttcctgtgccgataaagcctatcttcaatggtttcccctcctttgagctattatcctctaaaccatatgtgttatgaaaataaaatatgacgaaagcggggaacatgcacgatgaattggttgaatcagcataagaaagcaattattttagcggcttctgcggctgttttcacagcgattatgatctttctggccacagggaaaaataaagagccggtgaagcaagctgtaccaacagagacagaaaatacagtggtaaagcaggaagcaaacaacgacgagtcaaacgaaacaattgtgatagacatcaaaggtgctgttcagcatcctggcgtttatgaaatgcgaacaggggacagagtatctcaggcaattgagaaagcgggcgggacctgtgaacaagcagacgaagcgcaagtaaatttggcggagattctgcaggacgggacagtggtgtacatcccgaaaaagggagaggaaacagcagtgcagcaaggtggcggaggatctgtccaaagcgatggagggaagggagcgctggtgaatatcaatacagcaaccttagaggagttacaaggcatctcaggggtggggccatccaaagctgaagctattattgcataccgggaagaaaacgggcgtttccaaacaattgaagatatcactaaggtttcaggaataggtgaaaagtcatttgagaaaataaagtcttccattacagtaaagtgatttgacggtcatgcattatgataggtaaactaaaggtcaggcaacacaacatttggagggaacaacgtggaacgaatttcatggaatcaatactttatggctcaaagccatttattggcgctgcgcagcacatgtccgagattatctgtcggcgctactatagtcagagacaaacgcatgatagcaggaggctacaatgggtcaatcgcgggcggcgtacattgtgcagatgaaggatgcttaatgatagatgatcattgcgcaagaaccattcacgctgaaatgaatgcgattcttcaatgctctaagtttggggtgccgactgatggagccgagatttatgtgacgcattatccgtgcattcaatgctgcaaatctattattcaagcgggtatcaaaacggtttattatgctgaggattacaaaacacatccgtatgcgcaggaattatttgaacaggcgggtgtaacagttgaacaggttgaactcgatgaaatgatcgttgatctgaaaaacagggaaaagctttcatttgtagcgggtcttatagggaaattggctgatgccggtttagcggaggaagaattgaaaaagatacatgaacaggcgaatacacttttcacgagctacgtgtgatgaatgcgtaattcgcgcttattattgcctatggcggcagcttcggcaacggctggaattactgccgccgcttatttccccgctatttttcttttcatcctctttctcctcatcattttaatcaaaacgaggcacgcttttctcattattgtttgtttcttctcttttatattgttttttgtactgtatgcagtcacagattctcagaatgtctcttcctatcggcagggaacctatcaattcaaggcagtgattgacactattcccaaaattgacggcgaccgtatgtctatgatggttgagacacctgataaggaaaaatgggctgctgcgtatcgcattcagtctgctggtgaaaaagaacagctgttatacatagaaccaggaatgtcatgtgagttgactggtacattggaagaaccgaatcacgcaactgtgccgggtgcatttgattataacgagtatctttatcggcagcatattcattggaactactctgtcacgtctattcaaaactgcagcgaacctgaaaattttaagtacaaggtgctcagcttgagaaaacatatcatatcattcacaaacagccttttgcctcctgattcggcagggattgtacaggcacttacagttggtgacagattttatgtggaggatgaagtgcttaccgcgtatcaaaagcttggtgttgtccatctcttggcaatatcaggactccacgtggggattttgacagcaggtttgttttatatcatgattcgccttggtataactagagaaaaggcgtcaattctgttgctgttatttctgccgctctatgtgatgttgaccggcgctgctccttcagtgctacgcgccgctctcatgtcgggtgtttacttagctggaagccttgtcaaatggcgtgtccactctgcaactgcaatttgtctttcatacatcgtccttctgctcttcaatccttatcatctctttgaagccggttttcagctatcgttcgccgtcagtttttctttaattctatcctcttctatttttcatcaggttaaaacctccttggggcagctgacaattgtatcactcatcgctcagctgggctcgcttccgattctcctatatcattttcatcagttttctatcatcagcgtaccgatgaatatgttgatggtaccattttataccttctgtattttgccgggagctgtagcaggtgttcttctattaagtctttccgtttcgtttgggagattgtttttcagctggtttgatttattgataagctggaccaataggctaatcacaaacattgcagatgttgaagtgttcacgattatgatcgcacatcctgcacctgttttgctttttttattcacggtcacgatcatcctattgcttatggcgattgaaaaacgctccttgtcgcagttgatggtaaccggaggcatttgctgcacggtgatgtttctgctctttatatatccgtgtcttagttccgaaggagaagtggatatgatagatattggacagggtgacagcatgtttgtaggtgctccgcatcagcggggtcgtgtcttaattgataccggcggcactttgtcttactcgtcagagccttggcgcgaaaaacagcatccgttttcactgggggaaaaggtgctgattccgtttttaactgctaagggaatcaaacagcttgacgctttaattctgacgcacgctgaccaagatcatatcggagaggcggagactctgctgaagcatcataaagtaaagcgcctcgtgattccgaaggggttcgtttctgaacctaaagatgagaaagtgctgcagacagccagagaagagggagtgacaattgaagaggtgaagcgaggcgatgtattgcaaataaaggatttgcagttccatgtactgtcacctgaaacacctgatccggcaagcaaaaataattcctctctcgttctgtggatggagacgggcgttctgagctggatcttgacgggtgatctggaaaaagaaggggaacaggaggtgatggacgtgtttccaaatattaaagcagatgtcttaaaggtggggcaccatgggagcaaaggctctaccggtgaagaattcatccaacagcttcagccgaaaacggccattatctcagccgggaaaaacaatcggtaccatcatcctcatcaaaaagttctgcaactattacagagacattctatccgcgtgctgcgaacagatcaaaacggaacgatccaatatagatacaaaaacagagttggaaccttttctgtctatcctccatatgatacatcagatataacagagacgaactaaaaaaagactgccgagaaatcagcagcccgggcagtcgctgttatgaaccaactaggtgaataaccgttgccatgacaaacaagaaggcgaaaaatccgaaggacacaacaaaaccaacagctgaatctacagcatcatttcgtttgctttgaacgtttttttcaaaatcattcaactttatccctcctgactgacttaagtataatggaattgttttgaaaaatctagaagctaaggtaacgttttctgttctggtgattatcgcctttttacaagctgtcccgggggcttgcgaacaggcgtttaatataaatggggaagcagcagtcaggcttcctctttactattttgcaaactcaatttaggatagaaggggatgatgaaagagaggaagtcgtacaacaatggtatttgatgtgtggaaaagcctgaaaaaaggagatgtccatccagtttattgtttatacggaaaagagacatatctgctgcaagaaaccgtcagcaggatcagacagacggtcgttgatcaggagacaaaggatttcaatctatccgtttttgatctggaagaggacccgctggatcaagcgattgcagatgctgaaacgtttccgtttatgggagagcggcgtcttgtcattgtgaaaaatccatattttttaacaggtgaaaagaaaaaagaaaaaattgagcacaacgtcagtgcgcttgaatcatatatacaatcacctgcgccttacacagtctttgtcctgcttgctccgtatgaaaagcttgatgagcggaaaaagctgacgaaagcgttaaagaagcacgcgtttatgatggaggcgaaggaattaaacgcaaaggaaacgacagactttactgtcaaccttgcaaaaacagagcagaaaacaatcggcacggaagcggcggagcatttggttctgcttgtgaacgggcatctgtcatcgatttttcaggagattcaaaagctctgcacgtttattggagatcgtgaagaaattacgctggatgatgtgaaaatgcttgttgctagaagccttgaacaaaatatttttgagctgatcaataaaatcgtcaaccgaaaacgaactgagagtctgcaaattttttatgatttgcttaaacaaaatgaagaaccgatcaaaattatggcgcttatttcgaaccagttccggctgattctgcagacaaagtacttcgcggaacagggatacggacaaaaacaaatcgcttctaatctaaaagttcacccatttcgggtaaagctggcgatggatcaagcaaggcttttttcagaggaggagctccgttcaattattgaacagcttgccgtcatggactatgagatgaaaaccggaaaaaaggacaagcagcttctgctcgaactgttccttttacagctgttaaaaagaaatgaaaaaaacgatccccattattgaggatcgtttttatattatgcagaaagtccgttcacttttttcgctagtcttgatttgtatcgagctgcggtatttttgtgtacaagacctgttttcactgctttatcaatacgtttagctgcttcagtaagagcagttttcgctttgtcagcttcgttgttggcaacagaagcttcaacttgtttgattgcagtacgcatagcagatttgattgtcgcgttatgaacgcggcgttcgttgtttgtttttgtacgtttaatcgctgatttaatgtttggcatgtgtttcacctcctaagatacaacctgtagcacagtgtcttaaggttaaatcttcttcacaatagaacaaattgtattctatcaaacacacctttagattgcaatataaatgtaaagtatttttcattgaaggttctctttttagcatgatttattcagcaaatggcaacaatataggtacttaatgtgaaggaggcccctgtatgaaaaatagtgagctggatgtgaatcagtatttgatacggaccgatttggcagtggaaacgaaggaagcaatggccaatcagcaggctgtgccgacaaaagaaattaaaggctttattgaaaaagagcgtgatcacggcggtattaaaatccgcacagttgatgttacaaaggaaggcgcagagctttcgggaaaaaaagaagggcgctatttaacgcttgaagcacagggaatcagggagaatgattcggaaatgcaggagaaggtctctgctgtctttgcggaggaattctcagcttttcttgaaaaccttaatatctcaaaagatgcgagctgtttgatcgttgggctcggcaactggaacgtgacacctgatgcgcttgggccgatggcagtagaaaatctgttggtaacaaggcacttgtttaagcttcagccggaaaacgtacaggaggggtacaggcctgtcagtgcttttgcaccgggtgtaatggggataacaggaatcgaaacaagtgacattattaaaggtgtgattgagcaatcgaagcctgattttgtcatcgccattgatgcgttggcggcgcgggcggtggaaagggtcaacacaaccattcaaatatcggatacaggcattcacccgggatctggagtggggaataaacgaaaagatttaagcaaagacacgcttggtgttccggtgattgctatcggtgttccgacagtagttgatgccgtgacaattgccagcgacacggtggactacatattaaaacattttggcagagaaatgaaggataacaggccatcaagatcgcttgttccggcaggcatgacgtttgggaaaaagaaagtgctcactgaagaagatcttcccgatcaaaagcagcgccaatcgttcctaggtattgtcggaacccttcaagaagatgaaaaacggcagctcattcacgaggtgctttcgcctttagggcacaacttaatggttacaccgaaggaagtcgattcatttatcgacgatatggcaaatgttttagcgaacggattaaacacagcgcttcatgaaaaagtgtcacaagaaaacaaaggctcctacaatcactaaacagttctacttcctctagcttgttcatagagtaattactagacaagcgctggagggattcaatgagaaataaacgcaaaaacagacagattgttgttgcggtaaatggagggaaagcggtaaaagccatctttctatttatcgtaagccttatcgtgatttttgttctatccggtgtgctgacgtctctccggccggaacttaggccgtcgtctgactctttttatgggattgctgaagaattgccgggtgacgtatttgcacatttgctgcggatggaaaaccattatttcgcttctgacctctctcaaacagacagctcatttcatctttctcgtctttctttaaagctggcgacgagcattaacctcgaagatccgcggagctttctcggtcgggagctgccggggtttgcacaatttgataccgagattttgttagctggacaagggacggattatacgaatatgcctgcggaatcgccgccgccgtctaaggtgatggaggaagaaagggaagcgaatttggcagagattgaaaaacagcaaacgcaatcagataatgcgcaaaaagatccgccgaaacaaacaacaggtgataaaaaggtcgtgtttatctatcacacgcacaatacggaatcatatctccctctattaaaaggcgagaccgatcctgacatggcgcgccattctaaagccaatgtcacgcttgtaggagatatgttcggacaagcgcttgaatcccagggaatcggagccacagtgaataaaaccgatatacagtcaaaattgaataaaaaaggcttaaactatgccaggtcctatgatgaatcaaggccggtcgtgaaagacgccctcgcttcaaacaaaaatctgcaatatatcattgacatccacagagactctcggcgcaaaaaagacacaaccgcaacgattaaagggaaaagctatgccagggtagcctttgtcgtcgggaaaaaaagcaaaaacttcgaagaaaactataaaattgcaagtgagcttcataaactgatggagaaaaaataccccggacttagcacaggtgtcttttccaaaggctcgccaggcgataatggtgtttacaatcaggatttaaccgatagagcgcttttgctcgagtttggcggagtggataataatctcgaagagctgcagcgtgcggctaacgcggccgcggacgtattcagcgaaatgtactgggatgctgaaaaggtcaacgcagcgagcggggagacgaaaaaacaataagaaataggtggttgatttgattgcatactttggaaagtgcttactgcttgtcacgatcatgtttttaggcgttctgttcggcatgcagcaggcaaacaacgggatgctgagtatgaaaggctatcatgacgcttcactgaagggggcgtttacgctcaccgacggaaaagataatgaaaaagaagcctcaatcctaggagaaacagtcacggcaaaagatttagaagaaaaacaaaaagagctggaaaaggtggagacattcaatatgttttcaaaagccggaaaagcgctttcggacaccgtaaccaatactgcccagtcaatgtatgaatggatacgggatatgaatcaataagtacgtgaaagagaaaagcagcccagatatgatagggaacttttctctttcttgttttacattgaatctttacaatcctattgatataatctaagctagtgtattttgcgtttaatagtaggagtgatagattgtgacagataaagaaaagcgtttagagaggcaatcgagaatacggaatttctctatcattgcccatattgaccacggaaaatcgaccttagcggatcgtattttagaaaaaacgtcggcaatcactcaacgagaaatgaaagaacaattgctcgattctatggatcttgaacgtgagcggggcataaccattaaattaaactctgttcagcttaaatataaagcaaaagacggagaagaatatatctttcatctaatcgatacgccgggacacgtcgacttcacatatgaagtatcccgaagccttgctgcctgcgagggagcgattcttgtcgtggatgcagcccaggggattgaagcgcagacgctcgccaatgtctacttagcgcttgacaacgatcttgaaatccttccggtcatcaataaaatcgaccttccgagcgccgagcctgaacgtgtgcgccaagaggtagaagacgttatcggccttgatgcatcagaagccgtgcttgcttcagcaaaagccggtattgggattgaggagattttagaacaaatcgtagaaaaggtgccagctccgaccggagatccggaggcgccgctcaaagcgctgatcttcgactcgctttatgacgcctaccgcggtgtcgtggcttatatcagagtcgttgaaggaacggtaaagccgggacaaaaaatcaaaatgatggcaaccggcaaagaattcgaagtaacagaggtaggcgtgttcacgccgaaagcaactccgacaaatgaactgacggtcggtgatgtaggcttcctgactgcctcaatcaaaaatgtcggtgacacacgtgtcggtgatacaataacgagcgctgctaatcctgcagaagaagcgctgccgggataccgcaagctaaacccgatggtgtactgtggtttgtatccgattgatacagcgaagtataatgatttaagggaagctcttgaaaagcttgagctgaatgattcctcccttcaatatgaagcggaaacttcgcaagcgcttggattcgggttccgctgcggatttttaggcatgcttcacatggagatcattcaggagcgaattgagcgtgagttcaacatcgacctgattacaacagcgccaagcgttatctatgacgtgtacatgacagacggcgaaaaggtcgttgtcgacaacccgtccaacatgccggatcctcaaaagatcgaacgggttgaggagccatacgtaaaagcgacgatgatggtgccgaatgactatgtcggcgctgtgatggagctttgccaaggaaaacgcggcaatttcattgatatgcagtatttagacgcaaaccgtgtcagcatcatttatgatatgccattagcggaaatcgtatatgagttttttgaccagctgaaatcaagcactaaaggctatgcgtcctttgattatgaactgatcggctacaaaccgtccaagcttgtgaaaatggacattatgctgaatggtgaaaaaatcgatgccctttcctttatcgtgcatcgtgattacgcatatgaacgcggaaaagtgatcgttgaaaaactgaaagaactcattccgcgccagcagtttgaagttccggtacaagccgcaatcggccagaaaatcgtggcccgctccaccataaaagcaatgcgtaaaaacgtattggctaaatgttacggaggggacatctcgcgtaaacggaaacttcttgaaaaacaaaaagaaggaaaacgccgtatgaagcaggtcggctcagttgaagtgccgcaagaagcatttatggcagttctgaaaatggacgacagtccgaaaaaacaatagaagccgccgcagtcttgtactgcggcttctttctgtaaagaaggtgaatccgttgaaatcagcttatatccatatcccattttgtgagcatatttgccactactgcgatttcaataaatattttattcaaagtcagccagtcgacgagtatttaaacgcactcgaacaggaaatgataaatacaatagcaaaaactgggcagcctgatctcaaaacaatctttatcggaggaggcacgccgacctccctgtctggggaacagcttaaaaagctgatggacatgatcaaccgcgtactgaagccctcaagcgacttatcggaatttgcggttgaagcgaatccggatgacttgtccgcagagaaattaaaaatattaaaagaagcaggcgtaaatcgcctcagctttggtgtgcaaacgttcgaagacgatctgttagaaaaaatcggccgagtgcacaagcaaaaagatgtattcacctcttttgaaagagcgcgggaaatcggttttgagaatatcagtcttgatctcatgttcgggcttccggggcaaaccctcaagcatctggaacattccataaacactgctttatcattggacgccgagcattattccgtttactcccttattgtagaaccgaaaacggtattttataatttgatgcaaaaagggcggcttcatcttccgccgcaggagcaggaagctgaaatgtatgaaatggtgatgagccagatggaagctcacggcattcatcaatatgaaatcagcaactttgctaaggcaggcatggaatctaagcacaatctaacgtattggagcaacgaacaatatttcggtttcggagccggcgctcacggatatattggcggcacacgaacagtgaacgtcggacctgttaagcattacattgacctgatagctgaaaagggttttccgtacagagatacacatgaagtgacaacagaagaacagattgaggaagaaatgtttttaggtttgagaaaaacagccggtgtcagcaaaaaacgattcgcagaaaaatacggccgttccttggatggacttttcccaagcgtattaaaagacctcgctgaaaaagggctgattcacaattcggagtctgccgtttatttgactcatcaagggaaattattaggcaatgaagtttttggcgcttttttgggtgagttataattgacatttttcttgtggtttgatacttttgttatagaattagcactcgcttattgagagtgctaacagaggtgatgatgatgttaacaaatcgtcagctgctgatcctacaggttataatcaacgattttattaaatcggcacagccggtgggatcaagaactctttcgaaaaaagatgaaatcacatttagctctgcaacaataagaaacgagatggctgacttggaggaattgggctttattgaaaaaacccattcatcctcaggacgtgttccgtcagaaaaagggtatcggtactatgttgaccatttgctgtcacccgtcaaactgacgaaaagcgacctggaccaaatccactcgatcttcaaagagaaaattttcgagctggagaagacagttcaaaaatcagcgcaaattttgtccgatctgacgaattacacatccatcgtactcgggccgaagctgagtgagaattaccttaaacagattcaaatcattccgattcagcctgatatggcggtagcgattctcgttaccaatacggggcatgtggaaaacaaaacgattaactttccgaccaaaatggatctgtctgatattgaaaaactggtcaatatactgaacgaccgattaagcggcgttccaatggatgaactgaatgagcgcatatttaaggaagttgtcatgtacctaagacagcacattaagaactatgacaatatactcgacgcgcttcgttcaacctttcattccacaaaccacgttgaaaagttgttttttggcgggaaaatcaatatgctgaaccagcctgagttccatgatatcacccgagttcggtcgctgctttcattaattgagaaagaacaggatgttttaaagctggttcaatccccgcacacgggaatttcgattaaaatcggaaaagaaaacgactatgaagagatggaaaattgcagtctgattacggcttcttattccgtagaccagaagcagatcggctcaattgcgattatcggcccgacccgcatgaattattccagggttgtcagcctgcttcagcatgtgacttcggacttgtcaaaagcattaacaagtctgtatgatgaataagggaattttggcaaattttatcgaagggcagcacctgtccttctccttacactttgagggaggtgaacacaatgtcagaagaaaaacaaaccgttgaacaaaatgaaacagaagagcaagaaatcattgaagaacaagctgccgctgatgaacatcaggaagaaacaaatgaaagcgaactgcttcaaaaccaaattaacgaattgcaaggtttgcttgaggaaaaagaaaacaaacttttgcgtgttcaagcagactttgaaaactataaacgacgcagccgtttagagatggaagcgtcccaaaaataccgttctcaaaatatcgtgactgatttgctgccggcccttgacagctttgaacgagcgcttcaggttgaagccgacaatgaacagacgaaaagtttgcttcagggaatggaaatggtccaccgtcagctcgtagaagccttgaaaaaagaaggcgtcgaagccatcgaagctgtagggcaggaatttgatcctaatctgcaccaagctgttatgcaggctgaagacgaaaactacggctcaaacattgttgttgaggaaatgcaaaaaggctataagctgaaggatcgcgtcattcgcccttccatggtcaaagtgaatcaataattacatagcaggaggtttttcaagtgagtaaagttatcggaatcgacttaggaacaacaaactcatgtgtggcagtgcttgaaggcggcgagcctaaagttattgctaacgctgaaggaaaccgcacaacgccatcagttgttgcatttaaaaacggcgaacgtcaagtaggggaagtggctaaacgccaatctattacaaaccctaacacaattatgtctatcaaacgtcatatgggtactgattataaagttgaaattgaaggaaaggattacactccacaagaagtgtctgctatcatccttcaacaccttaaatcatacgctgaaagctatcttggcgaaacagtatcaaaagcagttatcacagttcctgcatactttaacgatgctgagcgtcaagcaacaaaagacgctggtaaaattgcaggtcttgaagtagaacgtatcatcaacgagccgactgcagcagcgcttgcatacggacttgataaaacagatgaagatcaaacgatcctagtatacgaccttggcggcggtacattcgacgtttccatccttgagcttggcgacggtgtattcgaagttcgttcaactgccggcgacaaccgtctgggtggggacgattttgaccaagttatcatcgatcatcttgtgtctgaattcaaaaaagaaaacggcattgatttgtcaaaagacaaaatggcgcttcagcgtttgaaagacgcagctgaaaaagcgaaaaaagatctttccggcgtatcttctacgcaaatttctttaccgtttatcacagctggagaagcaggaccgcttcaccttgaacttacattaactcgcgctaaattcgaagagctttcttctcatttagtagagcgcacaatgggtcctgtccgtcaagcgcttcaagatgcaggactttctgcaagcgaaatcgacaaagtcatccttgtcggtggatcaactcgtatccctgccgtacaagaagcaatcaaaaaagaaactggaaaagaagcgcataaaggcgtaaacccggatgaagttgtagcgcttggtgctgcgattcagggcggcgttatcacaggtgacgtaaaagatgttgttcttcttgacgttacaccgctttctctcggtatcgaaacaatgggcggcgtgtttacaaaactgatcgaccgcaacacgacgatcccaacaagcaaatctcaagtgttctcaactgctgctgataaccaaacagctgttgatatccatgttcttcaaggtgagcgcccaatgtctgccgacaacaaaacactcggccgcttccagcttactgatatcccgccagcaccgcgcggcgtgcctcaaatcgaagtttctttcgatattgacaaaaacggtatcgtaaacgtaagagcaaaagacttaggcacaggaaaagaacaaaacattacaattaaatcttcttcaggtctttctgatgaagagatcgaacgcatggtaaaagaagcggaagaaaatgctgacgctgatgcgaagaaaaaagaagaaatcgaagtccgcaacgaagcagatcagcttgttttccaaactgagaaaacattaaaagatcttgaaggcaaagtggacgaagaacaagtgaaaaaagccaacgatgccaaagatgctttaaaagcagcgattgagaaaaacgaatttgaagagatcaaagcgaaaaaagatgagcttcaaacaatcgttcaagagctttctatgaagctttatgaagaagctgctaaagcacagcaagctcaaggcggagcaaacgctgaaggcaaagcggatgacaacgttgtcgacgctgaatacgaagaagtaaacgacgaccaaaacaaaaaataagttctttttagtgtcagccccgcttccggagctgaccgaaaagaacacatttcataatctgattcaatgattagaaagtcaaagtcaggcatctcttggctttgactttttttcttgcccgggataaaaggaattgaaaaatcataattcaaaatgatacaatctaatttatgtgagaaattcgggagagtgaagcgagatgagtaagcgtgattactatgaagtgctgggagtaagtaagagcgcttcaaaggatgaaattaaaaaagcttatcggaagctgtcaaaaaaatatcatcctgatattaacaaagaagccggatcagatgaaaaatttaaagaggtaaaagaagcatacgaaacgctgtcagatgaccaaaaacgtgcgcattacgatcaatttggtcacactgatcctaaccaaggcttcggcggcggaggttttggcggcggcgatttcggcggttttggtttcgatgatattttctcaagtatattcggcggaggcacaagacgaagagatcccaacgctccgcgccagggtgctgatttacagtatacgatgaccctgtcgtttgaggatgcggctttcggtaaagaaacaactatcgaaattccccgtgaggaaacgtgcgagacatgtaaaggctcaggtgcgaaacctggcacaaatccagaaacatgctcccactgcggaggctccggccagttaaacgtggagcaaaatacaccgtttggaaaagtcgttaacagacgggtctgccaccactgtgaaggtacaggcaaaatcattaaaaacaaatgtgcggactgcggcggcaaaggaaaaatcaaaaaacgcaagaaaatcaacgtgacaattccagctggtgtagatgacgggcagcagcttcgtctctcgggacagggtgaaccaggaataaacggcggccctgctggggatttatttgtcgtgttccatgtacgcgcacacgagttcttcgagcgtgacggcgatgatatttactgtgaaatgccgttaacgtttgctcaggctgctcttggagatgaggtagaagtgccgacgctgcatggaaaagtgaaattgaaaattccggccggtacacaaacaggaacgaaatttagattaagaggcaaaggcgttcaaaatgtcagaggctatggacagggtgaccagcatatcgtcgtccgcgtcgttacgccgacaaatctgacagataaacaaaaagacattatccgcgaatttgccgaagtcagcggaaacctgcctgacgaacaggaaatgagtttctttgacaaggtaaaacgcgcgtttaaaggcgattaattattggatgaggagttggtagttttgaaatggtccgaattaagcattcacacaacacatgaagcggtcgaacctatctcaaatatattgcatgaagctggtgcaagtggggttgtgatagaggacccgcttgatttaattaaagaacgtgagaatgtgtacggggaaatctaccagctcgaccccaatgattacccagatgagggtgtcattgtcaaagcatatctgccggttaacagttttctgggcgaaactgtagacggcattaaagaaacgattaataatctccttctttacaatattgatttgggcagaaaccacatcactatttctgaagtaaatgaagaagagtgggcgactgcctggaaaaagtattatcatcctgtgaaaatttctgaaaagtttacaattgtgccgacgtgggaggaatatacgccagtccatactgatgaactgattattgaaatggacccgggaatggctttcggcacagggacacatccgacaaccgtactctgcattcaggcgcttgaacgctttgtgcaaaagggtgataaggtgattgatgtcggcactggttcgggaattttaagtattgcggctgcaatgcttgaggctgaatcggttcatgcctacgatcttgatcccgtggctgtagaaagtgcacgcctcaatctcaagctgaacaaagtcagcgatattgctcaagtgaagcaaaacaatttgttagacgggattgaaggggaacatgatgtaattgtggccaatattttggctgaagtcattcttcgctttacttcacaagcgtacagcctgttaaaagaaggcggccactttattacgtcaggaatcatcggtcataaaaaacaagaagtaaaagaagcactggaacaagctggctttaccattgtagaaatcctttcaatggaagattgggtcagcattattgcgaaaaaataacagttagtaggtgtcacagcgtatgcaacgatattttatcgagctcacgaagcagcaaatagaggaagcgccggctttttcgattaccggcgaagatgttcatcatattgtgaacgtgatgagaatgaatgagggagatcagattatctgctgctctcaagacggcttcgaggcaaaatgtgaacttcaatctgtttccaaagataaagtgtcctgccttgtgatagaatggacgaatgaaaacagagagcttccgataaaggtctatattgcgagcggccttccgaaaggagataagcttgaatggattatccaaaaggggactgagctcggagctcatgcctttattcctttccaagccgcgcgttctgttgtcaagctggatgacaaaaaggcaaagaaaaagcgggaaagatggacgaaaattgcaaaggaagcggctgagcaatcgtaccgtaacgaagtgccgcgagtgatggatgtccattcttttcagcagcttcttcaaaggatgcaggatttcgataaatgtgtcgttgcatacgaggagtcatcgaagcaaggggaaataagcgcattcagcgcgattgcaagcagccttccgaaaggatcatctctattgatcgtatttggtcccgaaggcggtttaacagaagcggaggttgcacggctcacagagcaagacggtgtgccgtgcggccttggaccgagaattttaaggacagaaaccgctccgctatacgcgttgagtgcgatttcttatcaaacagagttattaagaggtgatcagtaatggcaactgttgctttccatacgcttggctgtaaagtcaaccattatgaaacagaagcaatctggcagcttttcaaagaagcgggctatgaaagaagagactttgaacaaacagctgatgtatatgtcattaatacatgtacggttacaaatacgggagataaaaaaagccgccaagtgatcagacgcgccattcgtcaaaatcctgacggtgtcatctgtgtcacaggctgctacgcgcaaacctcacctgctgagattatggcgatccccggtgtcgacattgtagttggaacacaggaccgtgaaaaaatgcttggctacattgaccaataccgagaagaacgccagccgattaatggcgtcagcaacatcatgaaagcaagagtatatgaagagcttgatgtgcctgctttcacggaccgcacaagagcgtcattgaaaatacaggagggctgcaataatttctgcacattctgtatcattccgtgggcgcgcggcctgctccgctcccgcgatcctgaagaagtcattaaacaagcgcagcagcttgttgatgccggatataaggaaattgttcttacgggtattcatacaggcggctacggcgaagatatgaaagattacaacttcgcgaagcttttgagcgaattagacacccgtgtaaaaggcgtgaaacggatcagaatttcttcaatcgaagccagccaaatcactgacgaagtgatcgaggtcttagaccgctcagataagatagtgaatcatttgcatattccgatccaatccggatcaaacacagtgcttaaacggatgagacgcaaatatacaatggaattctttgcagaccgtttaaataaattgaaaaaagcactgccaggcttagctgttacttctgatgtcatcgtcggattccctggagaaacagaagaagaatttatggaaacctataactttattaaagaacataaattctctgaactgcatgttttcccttacagtaaacgtacaggaacaccagctgcgcgaatggaagaccaagtggatgaaaacgtgaaaaacgaacgtgtgcaccgcctgattgctctttctgaccagcttgcaaaagaatacgcttctcagtatgaaaatgaagtgcttgagattattcctgaggaagcctataaagaaacagaagaagagaacatgtttgtcggttacacagacaactatatgaaggttgttttcaaaggcacggaagatatgatcggcaaaatcgtaaaagtcaaaatcctaaaagcaggttatccttacaacgaaggacagtttgtccgtgtggttgaggatgaaataactgaacacatgcgtttgtcttcttaacctaaaaaatcggtgcattaaaatgtaccggttttttatttagccgggataagaaggtgaatcaatcggtaaaacaagtttgtaagcggaagaaacaaaagagctgtcaccacattaaataaaaggctgaaatgagcaatcctttgggcaggatcaggtgataactgttctacaaagccggtcgctgcggtcagaaaaggcaatactagagcgacccctagcacgttaaataccacatgggcatacgctgtctgtttcgccgcatatccgccggatacagcagccatgacagctgtaatgcatgtcccgatatttgatccgagtacgacgctcatcgcctgtgtcagtccgataatcccttcattcataaaactcatcaaaatgccgatacagacagaactggagtgaatgatggcagttaacaccatcccgattagcaaagcggaccagtttgaatcgttaacatggtatagaacgtcggcccccgttttcagcttcgtcagcggcccggcaagatggctgaatccgctgatgcaaaagaagatgatgcccagtccaaggaagcttgttcccagctgtttcaaaggatacctgccagtcagaaaaaacaataaacctcctattaaaagaacccaaatcaaaatatccattttgatagcaataaattcagttgtaaaagtagagccaacatttgtccccagaatcatcgggatcgtccgcttaaaagaaagaacgcccgcacttacaaagccgatgacaatgaccataaaggctgagctgctctgaagtatccccgtaaatacaatactgataagaaacgcttttaacggatggtctgtaaataaaagcaaacgttcttcaatttttgagtacgccattgaaattaagccctttcgaagcatgttcatgcctgcgagaaagaataatataagagcagtaaagctaatcagaattaacatcctattcaccaacccctttctttcattatatagacaggcagtcgcactcatgacggaaaagtgaactcacttagttgacctgactgatggcttatattataatgtcaaagtacatgtttatatgtgtaacttaaaggtagtcgattggtgtattcggagggagggaaagagaatgtcaaaaacggtcgttagaaaaaacgaatcgcttgaagatgctcttcgtcgcttcaaacgcagtgtatcaaagacaggtactttgcaagaagcaagaaagcgtgaattttatgaaaaacctagcgtaaagcgcaagaaaaagtctgaagctgctagaaaacgcaaattctaaaagagggtggatttatgagtcttcttgagcgtctcaaccaggatatgaagctgtatatgaaaaaccgtgagaaagacaaactgactgtcgttcgaatggttaaggcttcacttcaaaatgaagcaattaagcttaagaaagacagtttgaccgaggatgaggaactcactgtcctttctcgtgaacttaagcaacgtaaagactccctccaggaattttcaaacgctaatcgtttagatttagtagataaagttcaaaaagagctggacattttagaagtttatttacctgagcagctgtcagaagaagagctgcgtacaatcgtaaatgaaaccatcgcggaggtcggtgcgagctcaaaagcggacatgggcaaagtgatgggggcaattatgcctaaagtaaaaggtaaagctgacggaagtttaattaataagcttgtgagcagtcaactgtcttaaatggcaaagaaaaggacatctttctaagagagatgtctttttttatacataaaaaaatgaaacctttgatacatttgttacgtatgaagagaaggcacttattataaaaggaaggagggatacaccgcccttgcttcaaatcaaaggattccgtgctgctcttttgagtatatttttgctttctttattaggcgtacaactgaacgcaaaagcagaaaaacaaactgtttatgtgattccggttgaaaaaaatgtcgaacagggtctcgcctcgtttttgtcccgttcgttacaagatgcaaaggatgcacatgcagaccatattattctcgatatcaataccccggggggattggtcaaatctgctattgatatggccgatttgataaccgaaagcgagatccccgtaactgcatatgtcaacaaacgcgcgttgtctgctggtgcatatattgcacttcaagcagatcacatttatatggcgcctggcggaaaaatgggagccgccgcgattgttgatggccaaggcaatgccgctgaccaaaaagctcaatcactttggctggcagagatggaagattccgcagtgaaaaataaccgcgatccaaaatatgcgctcgcaatggctgacccagatatagatgccaaggaagttggcgcgcctaagggagatctgctgacacttaacgcagacaaggcgattgaggtaggctattcagaaggcactgctgacaatttctccacgctcgtaaagaagcttgggttcgaaaaggcgcagatcagctatgcaaaggagagctttgcggaaaagacagcaagatggctgacgaatccggtcattgtccctattctgctgacaatcgcttttttaggtctgacggtagagcttttttccccgggtgtcggcctccctggaacggctggactcattgcgttattgctgttcttttacgggcatcttgcagccggccttgccgggtatgagacggttctcctctttatagcaggggtgattctcattctgcttgagatttttcttcccggaggaatcattggattactgggcttgggagcgattattgcgagcctgtttttagccgcggggagcttcactgtcatggcggtttctctcttgatcgcctcagctgtttcgattacagcttttattttactgacaagggtgttgggaaagcgtatgaaattctttaagaaattgatattaaatgattctacaaacacggagagcggctacgtttcaaatcaaacgcgcacggacttaatgggaaaagtgggtataacctttacaccgctgcgtccttccggtaccgtgattattgatgatgaacgccttgacgttgtttcggagggatcgtttacagaaaaagataaaaaagtaaaagtgattaaagtagaaggctcacgcattgtcgtgagagaaatttaaatagaaacgaggagaagttatatggatccgtcaacacttatgattctggcaattgtcgcagtagcgatcattgttttggcagtattttttacatttgtgcctgtaatgctttggatttcagctttggcagccggagtgaaaatcagcattttcactctagttgggatgaggcttcgccgcgtcattccgaatcgggttgttaacccgctgattaaagcgcataaagcgggacttaatgttggaacaaaccagcttgaaagccactatctggctggaggtaatgttgaccgagtcgtcaacgcgcttatcgccgctcagcgagctaacattgaactcacattcgagcgctgtgctgccattgatcttgcaggccgggacgtgttggaagctgttcaaatgagtgttaatcctaaggtgattgaaacaccgttcattgccggtgtcgcaatggacgggattgaagtgaaagcgaaagcgagaatcacagtaagagcgaatatcgagcgcctcgtcgggggagcaggagaagaaaccattgtagctcgtgtaggtgaggggatcgtttctacaatcggttcatctgataatcataaaaaagtgcttgaaaaccctgacatgatttctcagacagtccttggaaaaggattggactcaggaactgcgtttgaaattctctcaattgatattgcagatgtagatatcggcaaaaacatcggtgcaattttacaaaccgatcaggctgaggctgataaaaacatcgcgcaggcaaaagcggaagaacgacgtgcgatggctgtcgctcaagaacaggaaatgcgtgcccgcgtagaagagatgcgcgcgaaagtggtagaagccgaggcggaagtgccgcttgcgatggcagaagctttgcgtgaagggaatattggcgtcatggattacatgaatatcaagaatatcgatgctgacacagaaatgcgtgattcattcggcaagctgacgaaagacccttcggatgaagaccgcaaatcataatctctctaagaagggagaacgctgatggaagatttactgaccaatccgcttattattgcagcgatcatcggaatcatttctgcgattttcggcaaaaagagcaaagaagaaaagcaaaacagccaaaaaagaaaaaaacctcaacacgtgcaatctgcttctcctcaaaagaagcagtcaaaagaagatgcccctgcacctatccctaaccgtatggaacaggcaagacgggaagcggaagaaagacgcagggaaacagcaagaaacctgaaagggctggaacgagatcttgctgctgccaaacaaaaaacagtatacacaaaacaaaaaatgcttcaggtgaataaagacaccgtcgtacaggggatcgttctaggagaggtgttcggacctccacgggcgaaaaaacctcaccgtacgatgcgctcggcccgtaaaaattaaagtgttagaacctcctttcaaatcatacatatgagatgaaagggggttctttttgtatggggcaaagaaagaatcgtatgaaagcttggctgacaagagcattggaaattcccccggacgttatgatggatctgccgaggattacaatggttggcagacttcatatctacatagaaaaccacagaggccttttgcttttcagtgagaatgaagtgcggctgatgctgaagcagggccagtgcatcatatctggtaaaaattttgtcatcaaggcgattcttccggaagagatacttttggagggtacgattgatgtcgttcgatatgttgagtcataaagccgagggggaaatgttgtgaaaaataaatggctgtcttttttttcgggtaaggtccagcttgaattgacgggaagagggattgaacggctccttaatgaatgcacaagacaggggattccggtctttcatgtcaaaaaaaagaaagaagccgtatcgttatatatacagcttcaggatgtacatgcctttcggcgggtgagaagtaaatttaaatgtaaagcccgatttatcaatcggaagggttttcccttcctgttgctgaaatcaaagctgaatatagggtttacgatcggttttgcgatttttttcatccttttgtttttgctgtccaatatggtgtggaaaattgatgtgacaggcgctaagcctgaaacagaacatcaaatgaggcagcatcttaatgaaatcggcgtcaaaaagggccgtctgcagtttttaatgatgtcgcccgaaaaaatacagaaatcattaaccaatggaatagacaatatcacttgggtcggagttgatctgaaggggacgaccattcacatgaaagttgtggagaaaaatgagcccgaaaaagaaaagtatgttagcccgcgcaatattgtcgccaaaaagaaagcaaccatcacgagaatgtttgtgcaaaaaggacagcccatggccgccatccacgatcatgttgaaaagggccagctgcttgtttcggggctgatcggcagcgaagaccatcagcaggaagtcgcctcaaaagcagaaatttacggagaaacctggtatagatcagaagtgacagtcccgcttgaaacattatttaacgtctatacgggcaaagtaaggacaaagcacaagctttcttttggttctttggcaatcccgatctgggggatgacgtttaaaaaagaggaattgaagcatccaaaaacagaacaagaaaagcattcgcttcattttctcggatttaagctccctgtatcctatgtcaaagagcaaacgagagaaagtgaagaggctttgcgaaaatatacaaaagaagaagcagttcaagaaggcattaaattgggtaaacaggatgtagaggataaaataggcgaaaacggcgaggtgaaaagtgaaaaagttttgcaccagactgttgagaatggtaaagtaaagttgattattctctaccaagttatagaagatatcgttcaaaccacacctattgtcagggagactgaagaatgacagaacatttacttgcgatgaatcaaaaactgaaaaacccggacgaggcgctttcactcttcgggaaccaagattcttttttgaaattgatggagaaagatctgaatgtaaatatcattacgcgcggcgagacgatttatgtttcaggcgatgatgaatcgtttcagattgcagacaggctgctgggatcgctcctcgctttaattcgcaaggggatagagatctctgaacgtgatgtgatttacgccatcaaaatggcaaagaagaatgaacttgaatactttgaaagcatgtatgaagaagaaattacaaaaaacgcaaaaggcaaatcaatccgtgtaaaaacaatgggacagcgggaatacgtggccgctatgaagcggaatgaccttgtattcggcattggtccggcgggaaccgggaaaacgtacctggctgtcgtaaaagcagtccatgctttaaaaaacggacatatcaaaaaaatcattttaacaagacctgccgtggaagccggtgaaagccttggttttctcccaggtgacctaaaagaaaaagtagatccttatttgcgcccgctgtatgacgctctccatgatgtgcttggggcagatcatacagaacgtctgatggaaagaggcatcattgaaattgctccgctcgcatatatgagggggcggacgctcgatgatgcttatgttatacttgatgaagcacagaataccacgcctgctcaaatgaaaatgtttttgacgagactgggttttggctctaaaatgatcattacaggtgacgtcagccaaattgatctgccgaaaggcgtcaaatcgggacttgcagtagcgaaggagatgctgaaaggaatagacggcatttctatgattgagctagaccagacagacgtggtcagacatccgcttgttgcgaaaattattgaagcatacgataagcaaaattaatgctgaatgacccgatcgcgcgttatcgggtcatttttatgattgcttatgggcttgatgtttcaagaggaggttcttgtgttgaaaaagaaggctaagaccaaaagcagctcgaaaaaatggagcagttttaaaaatgcccgctccatgcatgtactgctgtatcttctgctggctgccattatgtttgctttgctttttgtacatgttaagccggaaacacttgatttagacctgttttcagtcagcgacaagaccatttacgctccggcaaccgtagaagatcaaaaagccacagaggaaaaaaagcaagccgctgaggacgcggttgaagatcaatatacattaaaaaaagaatatacagacaatcggattgaccttgtgtcatcaatattcgacagtattagtgaagtgaaaaaatcatcggaagaaggcagtaaatcaccatcggaaaaatcaatggtcaaatctgtaaaggacaaattgacatcagatgtgaatgattctatatcggaggattccatcaagacattgctgaaagcagacagtgaagacttttcttttgtcagagatacggtcattaccgcagtaaatacggtcatgagcagtgaaatcccctcggataaactatctgatgcaaaggataaggtagaaaaagagctaaaaagcaattctattccttctaaatacttgggagctgcgacagaaatcgggcgttttgctattattccgaattacgtcttcgatccgaaagcaacagaggcaaaacggcaggaagcctcagataatgtccagcaggttcaaatcaaacaggggcaagtgctcgtggaagaaaatgacctcattgatcgggaagtgtacagaaaacttgagctgactgggttattaaataactcaaatctctttaaaccgatcagcgggctattgattatgatcggacttttcattgcaacacttgtatattattttgaaaaacagaaacaaaatctgaagtttaaaaaccaatccattctgttattctccataatcacaacacttttgcttgtgatcatggaggttgtcagtttgtttcagaagatggagtataataatatcggctatctggtccccattgcggccggcgccatcttaatcaaactgctgatgaatgaacgcattgccattttgggaagtatcattcttgcgatttgcggaagtatgatgtttaatcagggtgtgacaggaacattcaattatgtcatagggatttattatttgatcagcggcatttcaggtgtattatttttaggaaaacacaatgcaagatcaaagattttgcagaccggacttttcgtggcgtttattaatatggttgtcgttctatccttattattgatccagaacactgcgctgtcgggtcttgaaatcggcacgttaatgctcatgggggttgtgtcggggtttgcttcatctgtattgatcatcggcctgatgccgttttttgagacgggctttggcattttatccaccatgaggctgctcgagctgtctaatcctaaccatccgctattgcgcaaaatactgacggaaacaccaggtacatatcatcacagtgtaatggttgccaatttatcagaggcagcctgtgaagcggttggggctaatggtttgcttgcaagagtcggcgcatattatcacgatctcggaaaaacaaagcgcccgcaatattttattgaaaaccaaatgaatattgacaatccgcatgacaagctgtcacctcagttgagcaaaaatattattatctcgcatacgacagacggtgcgaatatgctgagaagctataaatttccgaaagagcttgtcgacattgctgagcagcatcatggaacctcgcttttaaagtttttttactataaagcgaaggaaaaaggcgaccagattacagaggaagagttccgttatccggggccgaagccgcagtcaaaggaagccgcaattatatcagtggccgacagtgttgaagcggccgtcagatccatgcataatccaaatcctgaacgaattgaaaagcttgtccggggtattatatccgataagcttcaggacggacagttcagtgaatgcgatttgacatttaaagagctggatacaatcgcaaaaacgctctgtgcaacattaaaaggaattttccactcccggattgaatatccggaggctactaagaaggtgaaatagatgagtttactgattgatatcgttgatgaaacaggaagcgtctcagaagagatgctcaaagaagtagaaaatctgcttcaatttgccgctgagtgtgaaggcgttcaggatcaggctgaagtttctgtcacgattgtttccaatgatgacatacatcagattaacaaagaataccggggaaaggatgctccgacagatgtcatctcatttgctcttgaagaagagggggaaggcgagatcgaaatcgtgggcgctgaaatgcctccggttttaggtgatattatcatcagtgccgatcgcacaagagagcaggcagaggagtataatcattcttttaaaagagagctcggatttctagctgtacacggatttctgcaccttttaggatatgaccatatgacgaaagaggaagaagaggagatgtttactaagcaaaaggaattgctggacgcttatggactcaaaagatcatagaaatgagctgaagcgattcttcaaaagcttcgtgcatgcaggccggggcatatgggaaacagcgcggacggagcggaatttccaatttcacgccgcagccgcctgcgctgttctcatttgcggcttccttgtagagctcagcatgattgagtggatgattatattccttttgataggcggtatgttttcgcttgagcttttaaatacagccattgaacatacggttgatttaataactgacaaacatcaccctcttgctaaagcggccaaggacgctgccgccggggctgtttgcgtttttgccgtgatttcgtgtatcattggtttacttatttttttgccaaagctgtaatggctgaaaattcttacatttattttacatttttagaaatgggcgtgaaaaaaagcgcgcgattatgtaaaatataaagtgatagcggtaccattataggtaagagaggaatgtacacatgaacagacaagaattaataacagaagctttaaaagcgcgtgatatggcatatgcgccgtattccaaattccaagtaggagccgctcttcttaccaaggatggaaaagtgtacagaggctgcaacattgagaacgcggcatacagcatgtgcaattgcgccgagcgtaccgctttatttaaagctgtttctgaaggggatacagagtttcagatgctggccgttgcggctgacacccctggaccggtatctccgtgcggagcctgccgccaggtgatttctgagctttgcacaaaagacgttattgtcgtactgactaatttacaaggacaaataaaagaaatgactgtggaagaattattgccaggcgcattttcatcggaggatttacatgacgaacgaaagctttaaatcaggatttgtatccattattggaagaccaaacgtaggaaaatctacatttttgaacagagtcattggacaaaaaatcgcgatcatgagcgataagccccaaacgacgagaaacaaggtgcaaggagtactgacgacaggcacatcacaaaccatttttattgacacaccagggattcataaacctaagcataagcttggggactttatgatgaaagtggcgcaaaatacattaaaagaagtcgatttgatcttgtttatgatcaatgctgaggaaggctacggaaagggcgacgaattcatcattgagaaattgcagacgatgtctacgcctgtattcttaatcgtaaacaaaatcgataaaattcatcccgaccaattgcttctgctaattgacgaataccgcaaacgttatccttttaaggaaattgttccgatttctgctttagaaggaaataacatcgaaaccttgctcgctcagattgaagcgtatttgccggaagggccgcaattctatccgagtgaccaggtaactgaccaccctgagcgatttatcatttctgaattaatcagggaaaaggtgctgcatttgacgagagaagaaatcccgcacagcattgcggtggccatcgaatccatcaaagggcaggacaacggttctgtgcacgtagcggcaacgattgtggtcgagcgggattcccagaaaggcatcgtgatcggtaaaaaaggaagccttctaaaagaggttggaaaaagagcgagagcggatattgaagcactgttgggctcccgtgtctaccttgaattgtgggtgaaagtgcagaaagactggcgtaataaaatgtcccagcttcgcgattttggctttaaagaggacgaatattaatctctagctgtgtgtgtcattatctcacaggaacagggatacattagcaaattttgtttaacatgaaatggaggacatctggtcaagataaaggtaagaatttggagtttaggtaagctagtttaactacagaaaggtgggtttcttgtgttgaattttacctggaacgtattttctcaaacaggaaatgttgatacgtatcttctttttaaagaactggaaaaagagaacatggaaagacccgaagaactagaagatgagctagcccgatttgattatccaattttataaacctcttggccgctcctgcttgaggaaggtgcggaaatgctgacaaaatgtgaaggaatcgttcttcgcacaaatgattacggagagacgaataaaatcgtaactttactgacaagagaacacggaaaaataggtgttatggcacgaggcgccaaaaaaccgaacagccgtttatcagcagtcagccagccctttttgtatggttctttcttaatgcaaaaaacatcgggcctcggaacgcttcagcagggggaaatgatcctcagcatgagaggcatcagggaagacttgtttttaacagcatatgctgcctatattgctgagttagtcgacagaggcacagaagaaaaaaagccaaatccttatttatttgaattcatattagaatcattaaaacagctgaatgaaggaacagatccggatgttatcaccttcattgttcaaatgaagatgctcggtgtcatgggcctgtatcctgagctaaatcattgtgtacattgtaaaagccaagacggaacctttcatttctctgttcgtgataatggttttatatgccaccgctgttttgaaaaagatccttacaggataccgatcaaaccgcaaacggcaaggctgttaagactcttttactattttgatctgtcgaggctcggcaatgtgtccttaaaagaggaaacaaaagctgaattaaagcaagtgattgatttatattacgaagaatattcgggattgtatttaaaatcaaagcgctttttagatcaaatggaaagcatgaaacatcttatgggtgaaaacaaaagttgacttttggtccatctttttatatgatcatttattataaaatatgttgcagtgagagaaagaagtacttgcgtttacctcatgaaagcgaccttagggcggtgtaagctaaggatgagcacgcaacgaaaggcattcttgagcaattttaaaaaagaggctgggattttgttctcagcaactagggtggaaccgcgggagaactctcgtccctatgtttgcggctggcaagcatagagacgggagttttttggttgctgccgcagtcaacttatgaaagaaaagtggaggtgcttgaaatgaatattcaagacatgattctaaccttgcaaaagcattggtccagtcagggctgtgtgcttatgcaggcttacgatgtagaaaaaggagccggcacgatgagcccgtatacatttttgcgcagtatcggtcctgagccgtggaaagtggcttatgtagagccttccagacgtccggcagacggccgctacggggagaacccgaacagactgtatcagcatcatcagttccaggtcattattaaaccgtcacctgataacattcaagagctgtatttggattccttgcgtgctcttggaattgatccgcttgagcacgatattcgctttgttgaagacaactgggagaatccgtctttaggctgcgcgggtctaggctgggaagtttggcttgacggaatggaaataacacaatttacgtatttccagcaggtcgggggattagagtgtaaacccgtttctgtagagattacgtatggaattgagcgtctcgcgtcttatatccaggataaagaaaacgtgtttgacttggaatggacgtcagggtttacagtaaaagatttattcatgatggctgaatatgagcattctgtttatacgtttgaaacatcagacgtcgatatgctgttccaattgttcagcacatatgaaaaagaagcgatcaagcaaatggacaacggacttgttcatccagcatatgactatgtgctgaaatgctcgcacactttcaacctgcttgatgccaaaggtgcgatctctgttaccgagcggacgggctatatcgcaagagtgcggaatttagctagaaaagtagcaaaaacctactatgaggaacgagaaaaactagggttcccaatgcttaaaggggagggttcttctcatgagtaaacaggatttacttttagagatcggattagaggaaatgccggcgcgctttttgaatgaaagcatggttcagcttggcgacaagctgacaggctggcttaaagaaaaaaatattactcacggtgaagtgaaactcttcaatacaccgagacgtcttgctgtgttcgttaaggatgtcgcagaaaagcaggatgatataaaagaagaagcaaaagggcctgcgaaaaaaattgcccttgatgcggacgggaactggacaaaagcggcaatcggcttttcaaaaggccaaggcgcaaatgtggaagacctgtacatcaaagaagtaaaaggcatagagtatgtattcgtgcaaaaattccaagccggccaagaaacgaagtcgcttctgccggaactgagcggtttaattacaagcttgcatttcccgaaaaacatgcgctggggaaatgaagatttgcgttatatccgaccgatcaaatggattgtcgcattatttggacaggatgtcattccattttcgatcacaaacgttgagtctggacggacaacacagggacatcgtttcctcggacatgaagtgtcaattgaatcaccttcagcttatgaagagcagctgaaagaacagcatgttattgctgatcctagcgtccgaaagcaaatgattcaatctcagctggaagcaatggctgctgaaaacgattggagcattccagttgacgaagaccttcttgatgaagtgaatcatttagtagaatacccgacagctctttacggttcatttgaatccgagtttctgtcaattcctgaagaagtgcttgtcacaacaatgaaagagcatcagcgctacttccctgtcaaagacaaaaacggtgacctgctgcctcactttatcacagtccgaaacggcaacagccacgcgattgaaaatgtggcccgaggcaatgaaaaagtgctgcgcgcacgtttatctgatgcgtcattcttctacaaggaagatcagaaactaaacattgatgcaaatgtgaagaagcttgaaaatatcgttttccatgaagagcttggttctcttgctgataaggttagaagagtcacatcaatcgcagagaaacttgccgttcgtcttcaggctgatgaagatacattaaaacatgtgaagcggggtgctgaaatttctaaattcgaccttgtgacgcatatgatatatgaattccctgaacttcaaggaattatgggcgaaaaatatgcgagaatgcttggcgaagatgaagctgtggcggcggcagttaatgaacattatatgcctagatcagcgggcggagaaacgccttctactttcatcggagctgttgtagcaatggcggataagcttgacacaatcgcttcattcttctctatcggcgtaattccgaccggttcccaggacccttacggactgcgccgccaagcaagcggtattgttgcgattcttcttgaccgcaactggggaatttcatttgaagagctgcttactttcgtacaaaccgataaagaaattgaactgctggatttcttcactcagcgcttgaaatatgtcttgaatgctgaacaaatcagacatgatgtcattgacgccgtgctggaaagctctgagcttgagccgtactctgcgctgcataaagcacaagtactggagcaaaagcttggtgcacctggttttaaggaaacagccgaagcgttaggccgagtgatctctatcagcaaaaaaggagtccgcggagacattcagcctgatctgtttgaaaatgaatacgaagcaaaactgtttgatgcctaccaaacagcgaagcaaaatctgcaggaaaacttcagcaaaaaagattatgaggcggcgcttgcttcacttgcagccttaaaagaaccgatcgatgcttacttcgatcatacaatggttatagcggataatgaggcattaaaggcaaatcgtttagcacaaatggtaagcttggcggatgagatcaagtcctttgcgaatatgaatgcccttattgtaaaataaagagagaaaaggcggttgctgtgtgatcggtaatcgtcttttccccatttataagttttttgtttgattacaagatatttacgttataatatggattattatttctttacatagctatgaagtgaaaaggtggtgagtacgatcgaactaaataaacggcaagaacatattttgcagattgtaaaagaaaacgggccgattacaggggagcatattgcagaaaagctgaacctaaccagggcgacattgcgcccggatttagccatactcaccatgtcaggattcctcgaggcgcgcccgagagtcggttatttctatacgggaaaaaccggcacacagcttttggcggataaactcaaaaagcttcaggtgaaagactttcaatctatccccgtagtgattcacgaaaacgtttctgtgtacgatgcgatttgcaccatgtttttagaagatgtaggtactctgtttgtggtggaccgcgatgctgttttagtcggggtgctttcacgaaaagacttgctcagagcgagcattggccagcaggagcttacatcggtccctgttcacatcatcatgacaaggatgccgaacattacggtgtgcagacgcgaggattatgtgatggacattgcaaagcatttaatagaaaaacaaattgatgcactgcctgtcatcaaagacaccgataaaggctttgaagtgatcggcagagtgacaaaaacaaatatgaccaaaatacttgtcagtttatctgaaaatgaaatcctataagattgcaaactaacggggggataatatgaataaccgcatcatctatgttgtatcggattccgtcggtgaaacggctgaattggtagtaaaagcagcactcagccaatttaacggatcggcggatgatacccatgtaagaagaattccttatgttgaagatataggcactatcaatgaagtgatttcacttgcaaaggcagacggcggcattatctgttttacactcgtggtgccggaaatcagagaatatttgatagccgaagcggaaaaagcaaatgttttatattatgatattatcggcccgttgattgataaaatggaaacagcctacggtttaacagcgaaatacgaaccggggcgggtgcgccagcttgatgaagattatttcaaaaaagtggaggccatcgagtttgcagttaaatacgatgatggacgtgatccaagagggattttaaaagctgatatcgttttgatcggcgtgtcaagaacgtctaaaacaccgctgtctcaatatctcgcacacaaacgcctgaaggttgccaatgttccgattgtaccggaggttgatccgccggaagaactctttaacgttgatccgaaaaaatgcatcggtttaaagattagccctgataaactgaatcatatcagaaaagaacgtttaaaatcactcgggcttaatgataaagcgatttatgcaaatatcaacagaatcaaagaggaactcgagtatttcgaaaagattgtggatcggatcggctgccaggttgttgatgtttcaaataaagcggttgaggaaacagcaaatattatccatcatctcaaaacaaaaaacatataactcaggacgctctatcctgggtttttggctgtgccaaaagggaataatgaaaaacaatagcatctttgtgaagtttgtattataataaaaaattgtgataaaatgattaattttaggtttaaggatcgtgtgatacgaataaactattatgggtaagatgtcaagaatttctcccggaaatttttcgacaaattcatatacatccacaataataaaggatgtgcgattttgcttgcttttatgcaggagtttaatggagggatggagaattactcttcttaatgaacaagaaaagacgatttttgtcgatgctgatgcttgtccggtaaaagatgaaattttacaaacagcatccgagtatgaagttcaagttctttttgtcgcttcatttgaacattatcagctttccagaagcaatgaagaaaaatggaagtatgttgatcctcataaagaagctgctgatttatatatcgcaaatcacgtgaaaccgggagatattgttgtgacgcaggacatcggattagcatctctgctgttgaacagaaatgtctctgttatgtcggaaagaggtcgtctttacaaggaagacacgattgattttgccctagagggccgtcatttttccggcaaacaaagaagaaaaggcgtatatgccaaagggcctaaaaaattgaataaagaagatcgagaacgatttattacactgctgcaaaaaatcctgtcgaacgatgaagggattttgcactaaagcatcgaataatgtacgacggagtgttataagatgggaaatcggataccagatgaaattgtggatcaggtgcaaaagtcggcagatatcgttgaagtcataggtgattatgttcaattaaagaagcaaggccgaaactactttggactatgtccttttcatggagaaagcacaccttcgttttccgtatcgcccgacaaacagatttttcattgctttggctgcggagcgggcggcaatgttttctcttttttaaggcagatggaaggctattcttttgccgagtcggtttctcaccttgctgacaaataccaaattgattttccagatgatataacagtccattccggagcccggccagagtcttctggagaacaaaaaatggctgaggcacatgagctcctgaagaaattttaccatcatttgttaataaatacaaaagaaggtcaagaggcactggattatctgctttctaggggctttacgaaagagctgattaatgaatttcagattggctatgctcttgattcttgggactttatcacgaaattccttgtaaagaggggatttagtgaggcgcaaatggaaaaagcgggtctcctgatcagacgcgaagacggaagcggatatttcgaccgcttcagaaaccgtgtcatgtttccgatccatgatcatcacggggctgttgttgctttctcaggcagggctcttggcagccagcagcctaagtatatgaacagtcctgaaaccccgctctttcataaaagcaaactgctttacaatttttataaggcccgccttcatatcagaaagcaggaaagagcagtcttatttgaagggtttgctgatgtcatatcggccgtaagctcgggtgtaaaggaaagcatagccacgatgggaacgtctcttacagatgatcatgtcaagatcctgagaagaaacgtcgaagaaatcattctttgctatgactctgataaagccggttatgaagccaccttaaaagcttcggagcttctgcaaaaaaaaggctgcaaagtcagagttgcaatgattcctgacggattggaccctgatgattacatcaaaaaattcggcggagaaaaatttaaaaacgacattattgacgcaagtgtcaccgtaatggcgttcaaaatgcaatatttccgaaaaggaaagaacctgtccgatgaaggcgaccgcctagcttacattaaagacgtactgaaagaaatcagcacgctttcagggtctctagagcaggaagtctatgtaaagcagcttgcttcagagttttcgctttcacaggagtctttaactgagcagctgtctgttttcagcaagcaaaacaaacctgctgacaatagcggtgaaactaaaacgcggcgagcgcatctgacgacaaaagcaaggcaaaaacgtttgcgtccggcgtatgaaaatgcagaaaggctgttactcgctcacatgcttcgagatcggagcgtcatcaaaaaagtgattgaccgggtagggtttcaatttaatattgatgagcaccgggcattagccgcttatctttatgctttttatgaagagggagccgagctgacgcctcagcatctgatggccagggtgacggatgatcatataagccagctcttgtccgatatattaatgcttcaggttaatcaagagcttagcgaagccgagttatcagattatgtaaaaaaagtgttgaatcaaagaaattggtcaatgataaaagaaaaagaggcggaaagagccgaagcagaaaggcaaaaagattttttaagagctgcttctttggctcaagaaatcgttacattgaaccgatctttaaaataactggagaactgatgaggagcatttattggcaatgattccttgcggaggagcaaatagatcgcttaacctcatcatgaattgtcatttcattattcgcacattgttaaaggcagttcacatagaaaacgcctgaatggaccgaataagaatcataccgcttatagaattcgttgcaagctttggaaggagggatccataatggctgataaacaaacccacgagacagaattaacattcgaccaagtaaaagagcaattaacagagtctggtaaaaaacgtggcgttttgacatatgaagaaattgctgagcgtatgtccagctttgaaattgaatcagaccaaatggatgagtattatgaatttttaggtgaacaaggtgttgaattaattagtgagaatgaagaaacagaagatcctaatattcagcagcttgccaaagccgaagaagaatttgaccttaatgacctaagtgtaccgcctggcgttaaaatcaatgacccagttcgtatgtatttaaaggaaatcggtcgggttaaccttctttctgcaaaagaagaaatcgcctacgctcaaaagattgaagaaggtgacgaagaatctaaacgcagattggctgaagcgaacctgcggcttgttgtcagtatcgcaaaacggtatgtcggacgcggtatgctgttccttgatctgatccaggaaggaaacatgggcctgatgaaagccgttgaaaaatttgattatcgcaaaggttataaattcagtacgtatgctacgtggtggatcagacaggcgattacacgcgccattgccgatcaggcgagaacgatccggattcccgttcatatggttgaaaccattaataaattaatccgtgtgcagcgtcaattactgcaagacttaggcagagaaccaacacctgaagaaattgcggaagatatggatttaacgcctgaaaaagtacgcgaaatcttaaagattgctcaagagccggtatctctggaaacaccgatcggtgaagaggatgactcgcaccttggtgatttcattgaagaccaagaagcaacttcaccttctgaccacgccgcatacgagctattgaaagagcagctggaagatgtgcttgatacgttaactgatcgtgaagaaaatgtattgcgtcttcgattcggtcttgatgacggccgtacaagaacattagaagaggtcggcaaagtatttggagtaacgagagagcgtattcgacaaatcgaagccaaagcgttgcggaaactaagacatcctagcagaagtaaacgtttgaaagatttccttgaataagatggaacgggtcttgaagatccgttcttcttttttttaaaaagatatatggataatatgcctttattttactgaaaaatgatgtcatttgcaaatgaacattgtggtgaaaaatttcaaaatctaattccatattttctattgtaagcgtatacaatacattatacaatagaataaaaaggatattagagatttaggcatgtttcaattcaattttgtataaagtgtgaataaaaaacttttgtatagcaatccatttactttttgtaaaaataagttagaattagaagtgtttacatagggggaaggatcaaaaagggggaagggaaatgaaatggaacccgcttattccatttttgctgatcgctgttttaggaattggtctaactttctttttatcagtaaaaggacttgatgactctcgggagattgcaagcggaggagaaagcaaatctgctgaaaagaaagatgcaaacgcttcaccagaagaaatttacaaggcaaactgcatcgcatgccacggtgaaaattatgaaggtgtttcgggtccgagcttaaaaggtgtaggggataagaaagatgtcgctgaaattaaaacaaagatcgaaaaaggcggtaatggaatgccttccggtcttgttccggccgataagctggatgatatggcagagtgggtgtcaaaaattaaataaaagaactatttttctctttatacattcacaggccgccgagatgttctcgacagccttttatttttgactgccgcgtgcagacccgcatcaaaagaaataatttcaaaatcatttgcttcagcttggattccgggctgattttttatatgatagtaaaggaaaaaatgattgagaaaagttgtgatgacaagtgaacgaattaaaattatctaaacgattgcaaacagtagcggagtacataccgaatggagcggtgatggccgatatcggctctgaccacgcctaccttccttgttatgcggtgctgaatcataaagccagcggggcgattgccggagaaataacagacggcccatttttgtctgcaaagcggcaggttgaaaaatcaggcttaaactcgcacatttctgtaaggcagggagacggactggaagtgattaaaaaaggtgaagctgatgccattacgattgccggaatgggcggatctttgatcgctcacattttagaagcgggcaaagacaaattaacggggaaggaacggcttattttacagccgaatattcatgctgttcatatcagggagtggctttataaagaaagatatgcgctgatagatgaggtaatccttgaagaggacggaaagtgctatgaggtgctggtggcagaagcgggagacagggatgcggcttatgacggtatttctttatcagccgggatgctcgtcggccctttcttggcaaaagaaaaaaatgctgtctttttgaaaaagtggacacaagagcttcagcacactcaaagcatttatgaacagatcagccaagcggcggatacagagcaaaacaaacaaaaattaaaggagctcgctgatcgaatggagctgttaaaggaggtaatcgatcatggctaaaagtgtaaatgggcagcagatcatccagctgtttgaacaattttccccgaaagcctatgcggttgaaggagataaaatcggcctgcaaatcggcactttaaacaaaccaattaaaaatgtgatggttacacttgatgtgttagagagcgttatcgatgaagcgattgaaaaagaggttgacttgattattgcacaccatcctcctattttccgaccgctaaagcatatttcaacagatcagcctgccggaaggttaattgaaaagtgtttgaagcatgatattgctgtttatgcagctcatacaaatttagacgttgcggacggcggcgtgaatgatttgcttgctgaagcattagagctgagtgagacggaagtgctggcacctacttatacggatcctctgaaaaagctggcagtttacgtgccgaaggaatatgaagagcaggtcagagccgcgctcggaaatgcgggggccggccatatcggtgaatacagccattgcgcgttttcatctgaaggaatcggcagctttaagccattggacggagctaagccttttatcggtgaagtgggagagcttgagcttgttcatgaagtaaggcttgagactgtatttcctaaaagcgtcgaaaaggctgttatcaatgcaatgataaaaagccatccatatgaagaagtcgcttacgatatctatcctgtcgaacagactcccgccgaaaaagggctcggccgtgtcggaacccttaaaaatgagatgacgctcaaggaattcgctttatttgtgaaagacaagcttgacgtcaatggtgtcagaatggttggggatgctgacagcatggtgaaaaaagtagctgttcttggcggagatggaaacaagtatattcatcatgcaaaacgaaagggagccgatgtttacgtcacaggagatttatacttccatgtggcccatgatgcgatgatgcttggcctaaatgtggttgatccgggccattacgcggaaaaaatcatgaaagaaggcgtcacgagaaaacttacatcaatgtgtaatgataaaaagtttggcgtgaatatctttgtttctgaaacagatacaaatccatttacatttctataaaaaaactgaggcttttacagcctcagttttttgcttttacttttggaagtatttttttgagcggtatattatgttcagttgtccaagttgatggatcttcgtgatcaaactgctctaaaaagcgaatgacttcttttgtgatcggcgtcggtgttgaagctcccgctgtaactgcaacggtattaacgcctttcagccattcgagcttcaattcgcttaagtcgccgatccggtatgcttttgtcccggctatttcctctgacacttgagcaagcctatttgaattgttgcttttcgggtctccgacaacgattgttaagtccgctttttttgcctgctctgatacagcttcctgccgcacttgagtagcgaggcaaatctcttggtgatattcgacatgaggatatttttctttgacaagctccataatgtcgtgaacatcccattgagacattgttgtttgattcgtcacgattaacttctcggcttggatatcaaggttctttacatcttcttctgtttcaactaagtgaacgatctccggcgctacgccaacggctccctcaggctctggatgcccttttttgccgatatagatcacgtgatatcctttttctttcatctctaagattagattatgagttttcgtcacatccggacatgtagcatcaattgcgactaaccctttttcttctgcgattcttctgacttcgggagaaacaccgtgcgcagtgaaaatgacagttcctttgtcaacctgctttaagatgtccagacggttagagccgtccaatgtaaaaatcccttcctcttcaaacgcatcagtgacgtgtttattatgaacaatcatcccgagtatatagatgggtcttggcaagcttttatctagcgacgcatttttggcaatgaccatagcatcaacaacaccatagcaatagccgcgcggtgaaatcttaattacgtccattttcggttgtcctccaatactgaagtgagtaaaggcaatataaaaagccgtaatcaaacggctctattcttgcattcttctgatctcattatagccaatctcacttcagatatcaaagaatgttaaatatataatctcggttttgaactgcctgatgttcttttcggagcaggagaggcagcttcctttttcttcggggcagatgtttttaattcttgttctttattgtcagttgttttagatttctttgggagagaagaactttttggttttgattttttgttcccatctgaggtttttgtttcagtctctttttctttttctgatgattcttctgaaacggattgtttttcactttcctcattggcctctgtctcagtatcatcacttttacttaattggctgtacagcttcatcattgctggcagattgcggactaatgggccgtactgctggatcataggggtgacttgctgcgccatgccgagtactttttgcacatttccaagcatactggataatgatgcaggattggcaatattttgaatgccttgcaggccagcacctccgctcgctgctgcacctgctcctggaattccgggaaccccggcgctgccagcgcctcctccgccggggaggaaccttgacagcattccttttaagcctccgcctccgcctgcacctgcacctgcaccatttctcgctccggcatttgcctgaggaagaaattgtccggcttgctgaaaaccttgctgctgtgctccaaatgaaggtcctcgcatattaggcggtcttctgcccatcattcgctgatttggcatggggcggggcggtccgggctgtgggtaatttctcattggctgctgcggtgaaaacatacttgtacctcctttcagctctctctgctattagaatatgcatgggctgcggtatttgctttacataactgaataaaacaaacgccttgcaaacgtggtgtttttaagcaaaatcgggtataatgtgatgatggacacataatgtgccgctttaaggagctgggaaaaatgaaagaaacgaaatttgaactttatgaattgaaaccatttattatagatgcagtacatcgccttggtttttacgaaccgactgatatccagaaaaggctgattcctgcagtgttaaaaaaagaaagcgtcatcggccagtctcagacgggtactggaaagactcacgcttatttactgcctttattaaacaaaatcgatcctgctaaggatgtcgttcaggtagtcattacggctccgacaagagagctagccaaccagatatatcaggaagcgcttaaaatcacgcagggtgaggaaggcagtcagattcgctcgaaatgttttatcggaggcactgataaacaaaaatcaattgataaattgaaaatacagccgcatcttgttgtcggtacacccggacggattgctgacttaatcaaagaacaggcgttaagtgttcataaagcggaatctcttgttattgatgaagcggatttaatgctggacatgggattccttgcagatgtagattacatcggttcccgcatgcctgaaaatctgcaaatgcttgtgttctcagcgaccataccggaaaagctgaaaccatttttgaagaaatacatggaaaatccgaaatacgcccatgtggagccaaaacaggtgactgctgcgaaaatcgagcatatcctcattccttcgaaacatcgtgacaaggacaagctcctttttgacatcatgtcgcatctgaatccatacctggggattgtgtttgccaacacgaaaaatacggctgaccatattgcccagtatctgactggcaaaggcatgaaaatcggcttgctgcacggcggattaacaccacgtgagcggaaaaaagtcatgaagcagatcaatgatttggaattcacatatatcattgcaactgaccttgccgcaagaggtattgatattaaaggtgtcagccatgttatcaactatgagctgccggatgatctcgatttctatgttcaccgtgtgggcagaacggctcgtgccggctcatcaggacaagcgatgaccatttatgagcttactgatgaagatgcattagtaagacttgaaaaaatgggcatcgaatttgagtacttagagcttgaaaagggcgaatggaaaaaaggcgatgaccgtcagcgccgcaaaaaacgtaaaaaaacgccgaatgaagcggatgaaattgctcatcgtctcgtgaaaaagccgaagaaggttaagcctgggtataaaaagaaaatgagctatgagatggagaaaatcaagaaaaaacagagaagaaaccaatctaacaaaagaaagtaggggaacctgttgctgagaataggctcacacgtctctatgagcggaaaacatatgcttctggctgcaagccaggaagcagtctcttatggggcgaatacgtttatgatctatacaggcgcaccgcaaaatacgcgccgaaagaaaattgaagacttaaatatagaagcaggccgggcacatatgcaagaaaacggcattgacgagattatcgtacacgcgccttatattattaatattggcaacacgacaaatccgtccacttttgagctgggtgttgattttcttcgttcagaaattgaacggacagcggccatcggagcgaagcaaattgtccttcatcctggcgctcacgtaggggcaggagctgaagccggcatcaaaaaaattattgaaggcttaaatgaagtgattgatccgaatcaaaatgtccagattgcattagaaacaatggctggaaaaggatcagaatgcggcagaagctttgaggagcttgcgcagattatcgaaggcgttacacacaatgagcagctgtcagtgtgctttgacacgtgccatacacatgatgccgggtataacattgtcgaagactttgacggagtgctaaatgagttcgataaaatcattggcattgaccgtattaaagtgcttcatatcaatgacagcaaaaatgtcaaaggtgcgagaaaagaccgccatgaaaatattggctttggtgaaataggttttgacgcactgcaatatgttgttcaccatgagcagttaaaagacattccaaaaattcttgaaacaccatacgtcggtgaagataaaaagaacaaaaaaccgccataccgttttgagattgaaatgctgaaagaaaaacaatttgatgatacattgcttgaaaagattttacagcaataaaaaatgggggataacacccccattttttagcttgtaaattgtttgaatagttcattaactgtttgagctgtttctttcgatgtaatcgtctctacttgtttcagcagccgcattcgttcactctcattaaagatgtttacatttttcccgtataacaggttcgctacttcaacagcctgcgatcttgttaagctgattccgtattgttttgagtacttcagcaaatcatcagcagtagcctgattaagccgctgcaaaataattctttgaaataaaatcatcggtcattccacctccagacttaatgtatgggcaaatcagtaaaatgtgtcagtgtttaatggtaaaatagatttataatgtatttaaaatagttattgcaggaaaggagattttatgaccccaacaaaacaacataagaaagaaacatttacccattttattttcagggtctttatgattctggtaggagctgcatctgcggctgtaagtattgaattatttttaatccccaatgattttattgatggcgggattatcggtgtatcacttattttagaccacctctttatgtcaaacccctttctgaatttcgcttttttcgttgtcatattaaatattccttttatgatcttcggatataaatatatcggtaagacctttctagtctctacgtttatagggattgtcgggcttgccgttattgaatcctcacttcaccatgtagaagccattacaacccagcctattttggctactgtgttcggaggtcttttactcggctttggcgtcgggcttgttattcgaaatggaggttcaatggatggtacagaaattctcggtattttgctgaccaaaaaactcccgttttctgtaggtgagttcgttatgttcatcaatgtgttcattttcatttgggcagtttttgtgttcggtcctgagcaagcgatgtactcattcatgacttattatattgcgatgaaaacgattgatgccgtgatccaagggcttgatgaaacaaaagctgtcattattgtgtctgagcagtatgatgagatttccgacgcgattttgcaccgtctcggtcggggcacaacgaagctgaaggggaaaggcggatatacggacgaagaaaaagacgtaatttacgcggttgtcacaaggctggaagtgacaaagctcaaatcgatcgtgtttgaagttgatcaaaatgcattcataacaattatgaatactcatgaaacgagaggcggaaaattcaaaaacgcaatccactaggctttcatttacttttattcattttatgggtataattttatctgcagtaaagaaaatggcttgctggacagacagctgccattttctttttcatacatgtaatacgttcttaagcaaagcgaaaagggggacccttcatgaacgtacaagaagcgctgaacctactaaaagaaaacggatataaatatacaaacaaacgggaggatatgctgcagctttttgctgattcagacagatatcttaccgctaaaaacgtactgtctgcactgaatgatgattatccaggcttaagctttgatacaatctacagaaatctttctttatatgaagaacttgggattttggaaacaactgagctgtccggtgaaaagctcttccgatttaagtgttcattcacccatcaccaccatcattttatttgtcttgcctgcggcaaaacaaaggaaattgaatcatgtccgatggacaagctttgtgatgatttggatggctatcaggtcagcgggcataaatttgagatttacggcacatgccctgattgtacagcggaaaaccaagacaacactactgcgtaaaatgcgtatatatgaaaaaggggcccggtttgggctcctttttcagttattgacgcgtattaagtgatgcttgttgttgttcatccattgaacggcttctagccagttgtttactctgatgatgtttgaatcaatcggaagctgattataaggggaattgaacaaaatcaccggtatcccggcttctttcgcaatcatcatggcgttaccgtgatgatcctcaaaaaacaggtcgatgttatgattcttgaccgcttcaactttgtgatgaccgccaacgagttcgatgtggtcataatgaatgttttgtctgtcaaaccattcataggtaatatcagttaaatgagtccgtctcgctgtaatataaataagcttgtgctcctctttgagaagatcaagtgactgtttcgcatgctgtgcaagcaatgcttccttatatatgatcgcttcattttgattcatccaatcccaaaattcttcctgggtaatgtttaacagctttgttaaatcataatccgtcatatcgtttaatgaaatggaaagattaaacgaacggttcaaataagggacgaatgtatcctgagccgtgattgtgccgtcaatatctattcctaagcgtaacatgcccacactccttcagtttcatcccttcaagtgtaacataaacaattgacattaacagaaaagtttagcaaacatgaatcaggcaaaatggatcaaactataaaagctcctttaataaaacagaagggggaattgaaggtggcaaacgattacgaaaagcgtgataacaacagttactatgttgatcatggatctgaagggacaaatattacccgtgacaatgacggtttttttgaggaaacagctgctgaaatcgcagagccttatcgtgctgctgaccgcagcaatgaccaagacaatgatcgcagcggcggcaatgtcaatgaaggacggggaataggatatatcgctttagccttgtctattatttcattgtttgtactgcctgttttattgggagctgccggtattattgtcggctatatcgcaagaagaagaggtgctcaaggccttggcgcctgggcaatgggtatcggtgtcgtttcattagtgcttggaatatttattattccatttttctaacacaaaaaagcttgacgggttcccgtcaagctttttgtgtttcttcttttaattttgctttttcagcttcaagttttgcgtagtgttcctcagcaagaatgtcaatttcttttttgagttcttctaccatcgtttcctctggaaccttacggacaattttccctttccggaacagcagtccttcaccgcgtgcgccggcgattccgatatcagcttctctcgcttcaccaggtccgtttacagcgcagccgagaacagcaactttaatcggcgcttttatcttagaaatatactcttccacttcattggcaatgctgattaaatcaatttcaatacggccgcaagtcgggcatgagatgagcgtggcagcattggaggctaagccgaaagatttcagaagctcccttgctacttttacctcttctacagggtctgcgcttagtgaaatgcgcatggtgttcccgatgcctttgcttaaaatggcgccgagtcctgctgcgctctttactgtgccggcaaacagtgttcctgactcggtgatcccgaggtgaagcgggtagtcaaacgctttcgccgctttttcataagcctcgattgcaaggttcacgtcagaggccttcatgctgacaataatatcgtgaaaatcaagatcctcaagaattttaatgtgatgaagtgcgctttctaccattccatcggcagtcggataaccgtatttttctaaaatgcgtttttccaatgaaccggcgtttactccgattctgatcggaatgcctttgtctttggccgctttaacaaccgcttcaactttttcgcgccggccgatgttgccggggttgatgcggattttatctgcgccgccttcaatggctttcaacgcaagtttataatcgaaatgtatgtcaacaacgagaggaatggaaatgcgctttttaatatccgcaatggcgtttgctgcccgttcatcaggacatgctacccgaacgatttggcatccggcttcagccaaacggttaatttccgcaaccgttgcttctacatcatgtgtttttgttgttgtcatgctttggatgacaacttcattgttgccgcctattgttaaaggtcccactttgacgggacgcgtttttgtacgatgtgtgatttcactcacttgcaatcgctccttaattgtagttgccgcttctagatataacaattctagtatggtttatgtgaatttattttacaaattacattgtaacagtgtcttcgccgaactgacaagaaattaacgttaaattaagggtagaccgggaatttatacgctgttcccgcttgaatggcattggctttcacatttggattcagtgcttcaaaatcctttacaatgtcatccggagaacctgctgatccgactatcgacataaccgtatcacccggctttaccttcaccgttttataagccggttcttgtacagccgtttttgctgatgcttcatagacagggaggtcctgaatgggtatggttccaattttaaggtcataaaaaagaataaaaagtataaaaacaatgctgcatactaaggtgagacgcttcatcgcttttcctcccgcatacgaaattttataccatagtatgcttgtccatttcgattcatgacaaaagaaaagagactgcgaatgcagtctcggtttatacagcagcttttttggacggaatctcttttaaaacgagaaacaggatgacaaaattgacaaaccagttcagcaaaaattcacttggtacggttgcttctaatgcccgcatgattgtaaagaatacagttgaaagggtgatggaataagcagaaagcttccagagctgatgataggataaatgttttttctgcgaattcttaatgattaacccgataagcgctaaaaacgatacttcaataaattttcccgctgctgttacgagaaaaataagagctgagagaacagttacaatcatcgctttattttggtttaaccctgcaatgacatcttttttctgtaactctgatggcatcattgagtaagacatttcttgggcttgtccgtcaatggccaaaacaaatttgttctgaaggatgccgatcgcgttttgctttgcttcaatttgttcagtgccataggagtctgtcggatcgaacacgataacgaaaccatttgcttgagattccgtggcttttttctcatccgtttgaagtttgccgtttgaaattgtgaaatcagggaaatctttgtttaaaacagttttaaagccgttcattgattttacggtccctgtacttacataataagcggtagggattgcaaacaggacagagagcaaaaatacataaagaatcgcttttccgattccttgaaatcttgtttttgcaatatcacggggagagtatgtacttttaatgaaaagctgaaacacattcactatcttcacttcctagctaaactaatatatgttgcttattgtatcgttgcatgcgtgtgaatacaaggaagacatgaagaagacagagtaaaatgggaggatggaagctatggatatgttgtattggctgttgattgcagcggtttttatcattgcctttatcgggctggtgtatcctgttattccgagcgtagtatttattgttgccggatttgtattgtacggatttttattttcattcagtccgtattcttatatgttctggcttgttgaggcagtttttgccgcagtattattcgcagcagattacgtgtcgaatctgcttggagtaaaaaggttcggaggaagcaaagctgccatatggggaagcacgatcggtttattaatcgggccttttgtcattccggttgcagggatcatattggggccgtttatcggggctgtttgcgcagaacttatcgttcatcagaaggacttaaagtcagcgtttaaaattggcctcggctcactcattggttttttaacaggggttattgcaaagggcatcacacagcttttgatgatcggatactttttatggacggtcctataagaaatgctggcggcaggtttaatggggcagattatcggttaaagtgaaatatgtccgctgaaatgagccaaatcgtgagctttttcattgattacaaagcattcttttgttacattgaatgaagaaaggctcgctgtgaagcggcatttcagtacatatatactaaggaggaattatcatggcttacgaacttccagaattaccttatgcgtacgatgctttagaaccgcatatcgacaaggaaactatgactattcaccatacgaaacaccacaacacatacgtgacaaatttaaacaaagcggttgaaggaaacactgctcttgccaacaaatcagttgaagagcttgttgcagatcttgattctgttcctgaaaacatccgcactgcagtccgcaacaacggcggcggacacgcgaaccacaaattattctggacacttttatctccaaacggcggaggcgaaccgactggcgcgcttgctgaagagattaacagtgtatttggaagctttgacaaattcaaagagcaattcgcagcagcagcagctggacgcttcggttctggctgggcatggcttgttgtgaacaacggtaaacttgaaatcacaagcacgccaaaccaagattctccgctttcagaaggcaaaacgcctatcttaggtcttgacgtttgggagcatgcttactaccttaactatcaaaaccgccgtcctgattacatttcagctttctggaatgttgtaaactgggacgaagtggctcgtctatacagcgaagcaaaataatggcacaaacaaggtcctcattatgggaccttgtttttttatgtcttctttttacatatctcggtttgagtgagacagactaagggatagtaaaggggagtcagtaatgagcaaactaaaaaaagtgataggcgatgtagacgtaaacaaagggttactctttctgctgaccattggcgggctttactcgctgggaattgcactgtccaatacatttgttaatgtgtatctttggaagcagtcagggaaatttattgatttggcgatatataatttatccattgtgacaatgcagccgataaccttttatttggctggacggttagccaaaaaaatagacagggtattcattttaaggttcggcgtcatttttttagctgccttttatttaagtgtgcttttagccggagaaacggcggccagccgcctcgtgctaatcggcgcggtgctcggagttggctatggcttttattggctagcgtttaacgtactgacctttgaaataacagagccggatacacgagactttttcaacgggtttatgggcattctgtcttcctctgcaggaatgatcggcccgattgtagccggattcgtgatctcaaggcttgaaaataatacgggttatacagtgattttcagtctctccctcagtttatttgccctggctgtcgtgatgagctttttcttaaaacggagagaatcaaagggccgttttatgctgagcaaagtatttggagagcgccatagcaatatgaattggcggagaatcacgaatgcgcatttttttcagggtttgagagaagggatttttgtctttttaatcagtgtgtttgtatttattgagacaaacagcgaacttgctctcggtacattcggtcttgtcaattcagctgtttccttctttgcctactactttgcatccaggctgattaagaaaaaggcgagaaaaaaatcgattttgctgggcggacttattttgtatggcgcgctgtttttgattctgttccatatgagcttttcgacattattaacgtatggcgtttttattgccatcggctatcctctgttgcttgtgccatatgtatcacttacatatgatgtgatagggcgcgcgaggcatgccagaaaagcaagaattgaatatatcgtgcttagagaaatgttcttgaacgccggcagaattgtttccattttgtgctttctcctgattgtggcccttctgaaagaggatgtgggaattcctttgtcacttgcgatattgggtataggacatcctttgatttattactttgtcaaggatatccgttttaaggagaaagaaggggaaaatgaaaccatggaagaagacggccaaaaacgggtaacagaaccgaccctgttaaaaggcgagagataatttttttgccaaaaaggggttatctgtagaaaaaagtcgaaaaaacctttaaaatgaaaactggcactcttacttgagtgtcttttctttctgtaaatagaaaaggtgatgttatgaggagaaataaaccaaaaaagcaaaatcataaagagaaaaagaagtcgcttccgatccggctgaatattttatttttagctgcctttgttatatttacctggattattgtggaactgggcatcaagcagatcgtgcaaggtgatgattacaaaaaccaagcgaataagcaggaacaaagtgaagtcagctcagcggtaccacgcgggaaaatttatgatcgaaactttaatgccattgtgacaaataaggctttaaatgcaatcacatacacgagatctaaatcgaccacgcaagaacagcgcttaaagatcgcaaaaaagctgtctgacatgatcaaagtcgatacaaaaaaagtaacagaacgggataaaaaagattattggattttgactagaccgaaagaagcgaaaaagctcattagctctaaagaaagacagcaggttgaagacaaaaaaatatccgatgacgatttataccagcttcagctaaaacggattactgataagcagctgaatgaattgacggataaagatatgcagatccttgctatcaaaagacagatggattcgggctatgcattgacccctcaatatatcaaaaacgaagatgtatcagcgaaggaaatggcagtggtaagtgaacatttagacgaactgccaggtgttgatgtcacgtccgattgggaacgtgaatatccgtataaaaaccttcttcgctcagtgctcggaagtgtttccagctctaatgaaggattgccgtccaacttgctcgaccattatctgtcgcttggctacagccgtaatgacagggtcggaaaaagctatttggaataccaatacgaaagccttctgcagggccaaaaagccaaagtcgaaaatatcacagattcaaacggcaatgtcacgggaacgaaaaccgtttctgaaggtaaagccggtaaagatctcgtgcttacgattgacattgatttgcaaaaagaagtggaaaaaatcattgagaagaacctcaaatctgctaaagcaagaccaagcacgcaattgttagaccgggcattcgttgtcatgatggacccaagaaacggtgaagtgctttcaatggcgggcaagcagattaaacaagaaaatgggaaatataaaattgatgattacgctttaggtacaatgacgtcatcttacgccatgggttcagcagtcaaaggggcaacagtcttgacaggccttcaaaccggtgccatcaacctgaatacagtttttcaggatgaaccattgtatatcggccaggataaaaatggtaaaaaatcctggactactttaggacctgttaacattcaaagagccttagagcagtcttccaacgtatttatgtttaaaacagcgatcgcgctcggaaaaggtgaatataaaccgcaccaggctttaccgattgatacgacggcctttgatacgttccgtaattatttcagccaatttggattaggtgtcaaaactggaattgatcttccgaatgaaatgacaggctataaaggaacagacagattgacgggattcttgcttgactatgcgatcgggcaatacgacacatatacaccgctggaacttgcgcaatacgtatcaacgattgcaaacggcggatatcgcttaaagcctcagcttgtaaaggaagtcagagaacctgatgctaaaagagggatcggtgctgtcgtacagtccgttcagccggaagtgctgaataaaatcgacatgaagagtgaatacattaaagaggttcaggccggattcagacgggtgatgacaaaagggacagctgccagccaatttgcttcagcgtcatatcagcctgccggcaaaacaggaacagcacaatcgttctatgatggacctgataaatcaaaaacaggaacagcgacttataatacgacacttgttgcctatgcaccggctgataatcctgagattgcgatctctgtagtagtcccttgggcttatattgattacagcgctaaatataccattacaaacgaaatcggcagggaagtaatggataaatattttgagctgaaatcgaagcaggacaaagaagatactcagcaaaagaataaagacaaaattgaagaaaatgcagaaaacacaacgtcttctgataactaaaaagaaacgctcacatgatgtgggcgttttttttatacaaaaaaacgcactgatttacaaaaccttaacattcggttcaaaccctttttacatagaacctttactctatacgtgtaggacaaattacacattatacgcagggggaattcaggaaatgaaaaaaaacaaattggtgcttatgcttctgatggctgcttttataatgattgcagctgcatgcggaaatgcaggagaaagtaaaaaatcgaatagcgattctgcaaaaggagaagaaaaggcatcaggttctttaaccatttctggttcatcggccatgcagccactagtacttgcagccgcggaaaaatttatggaagaaaaccctgatgctgatatacaggtacaagctggcggttctggaacagggctttctcaagtctctgaaggagctgttcagatcgggaattcagacgtttttgctgaagaaaaagaaggcatcgatgcaaaagcgcttgtcgatcatcaagtcgctgtagttggtatggcagcagctgtaaaccctgatgctggtgtgaaggatatttcaaaagatgaattgaaaaaaatcttcactggcaaaattaaaaactggaaagagctcggcggcaaagaccaaaagattacacttgtaaaccgtcctgattcttccggcacacgtgctacatttgtgaaatatgcgcttgacggagcggagcctgcagaaggcattactgaagattcctccaacacggtgaaaaaaatcattgctgatactccgggagcgattggatatcttgcattctcatatttaacagatgacaaagtaactcctctatctattgacggtgttaaacctgaagcgaaaaatgtagcaactggcgagtatccgatctgggcttatcagcattcttatacaaaaggtgaagcgacaggtttagctaaagaatttcttgattatctaaagagtgaagacattcaaaaaagcattgttactgaccaaggctacattccggttactgatatgaaagtgacacgcgatgccaacgggaagcaaagctgatcttaataaaaagaggagtgcggggacaaccgtttctcctcttaacacattcataggagtgtaaaacaatgataaacaatagagaaaatatgtctgtgagcgagcgtttaatcagctcaaggcaaaatcggcaattggatgaagttcggggaagaatgattgtgacagcatgtgcgctgattatgattgcggcatctgttgcaatcaccattttcctcggcgtgaaggggctgcaatcttttcttgtaaatggtgtaagcccaattgaattcttaacgagcttaaattggaatcctacagatagtgatccgaaatacggagtgctgccatttatttttggctcatttgcagtaacgattctttctgctctaatcgctgcgccgcttggcattgcaggtgcgatttttatgacagagattgccccgaattggggaaagaaagtgctgcagccggtgattgagcttttagtcggtattccatctgttgtttatggattcataggtcttacagtattggtgccgtttatcgcccagttcaaatcgagcggaacagggcacagtttattggcgggaacgattgtcctttccgtcatgattctgccgacgatcacatcgatttctgctgatgcaatggcttctcttccgaagagtttacgagagggttcttacgcgctcggtgcgacaagatggcagacaatcagaaaagtacttgtgcctgcagcttttccaacattgatgacagctgttgtgttaggcatggctcgggcgttcggtgaagctttggctgttcagatggtcattggaaatacaagagtattgccggaaagcctgtttgacactgcgggaacgctgacaacgatcatcacgctgaatatgggccacaccacatacggaagtgttgaaaacaatacgctgtggtcaatggggcttgtgcttctggtgatgtcattcttgttcatcctgcttattcgctacttgtcatctaggaggaaagtgtaatgaaccgcaaaataacagataaactggcgaccggaatgtttggtttgtgtgcagccattatcgctgccattttagtaggtttgttttcctatattattataaacggtgtttctcagctcagtttgcaatttattacaacaaaatcgagcgccattgcagctggaggaggcatacgagatcagctgtttaactccttttatattttgtttattacaatgctgattacaatcccgctcggtgtgggcggcggagtcttcatggctgaatacgcgcctaataacaaagtaactgacttcatcagaacatgtatagaggtgctttcatctcttccgtctattgtcattgggatgtttggattattgatgtttgtcaacttaacaggctggggatatacgatcataggcggggcgcttgcgttaactgtttttaaccttcctgtcatggtgcgtgtgacagaagacgcgatccgttcagtccctaaagatctgaaggaagcctctctcgctttaggtgtatcacgctggcataccgtaaaaacagttttaattccaagtgcgattccttctatcatcacaggagcaattttagcgtcaggaagggtgttcggggaagcggccgcattattatttacggcaggcctgacaacaccgcgtcttaattttacggagtggaacccgttttcggaaacatcaccgcttaatattttcaggcccgctgaaacacttgcggtccacatttggaacgtcaatacacaaggaatgattccggatgctgaagcgattgccaacggtggttctgccgtgctggtgatttctgttcttgtgtttaatctcgcggcgagatggcttggcacgatgatctacaaaaagcttacggcaaattagaacggaaagaggcgaaaaacatgtctgaacaaatggtaaaagaaaaacctgagcgagctgttattgttccgaagcagaatcacgtgcttgaggtcaaagatctgtctattttttacggaaataaacaagccgttcatcatgtaaacatggatattgaaaaaaatgcggtgactgctttaattgggccgtcgggatgcggaaaatctacttttttgagaaatattaaccgaatgaacgatttaattccatctgcaagagcggaaggtgaaatcctttatgaaggattaaatatattgggcggcaatattaacgttgtcagcttgagaagagaaatcggaatggtttttcaaaaaccaaatccatttccgaaatcgatctatgcgaatatcacacatgcattgaaatatgccggagagcggaataaagctgttttagatgaaattgtggaagaaagtttaacaaaagcggccctctgggatgaggtgaaggatcgtttacattcatccgcactctcgttatccggcggccagcagcagcgtttatgcatcgcgagaacgcttgcgatgaagccggctgttcttctgcttgatgaaccagcttcagcgcttgatccgatttcaaatgcgaaaatagaggaattaattacaggattgaaaagagaatactcaattattattgtcacgcacaatatgcagcaggctctgcgggtttctgaccggacggcattctttttaaacggcgagcttgtagaatacggacagaccgaacagattttcacgagtccgaaaaagcaaaagacagaggattatattaacgggaaattcggataggagggcggcaatgagtattgctaccgaagctgtaatgaaacaggaagtctatcaagtcaatggaatgaacttatggtatggacagcatcatgctttaaaaaatatcaatttgagcatttatgaaaatgaggttacggcgattatcggtccatccggatgcgggaaatcgacctttatcaagacattgaatttaatgattcaaatgacgccaaatgtaaagcttgcaggtgagctgaactataatggcagcaatattttaaaggataaagtggacatcgtggatttacggaaaaatatcggcatggtattccaaaaagggaacccgtttccgcaatctatttttgataatgtggcttacggaccgagagtccacggcaccaaaaataagaagaagcttcaggaaattgtggaaaagtcattaaaagacgtggcgttatgggatgaggtgaaggatcgattgcatacgtccgctctttcgctgtcagggggccagcagcagcgtctttgcatcgccagagcacttgcgaccaatcctgatattttgctgatggatgaaccgacatctgcactagatccaatctcaacgagaaaaattgaagaactcattctagagctgaaaaataaatatacaattgtcattgtcacgcataacatgcagcaggcagcaagggtttctgatcaaaccgcctttttctacatgggcgagcttgttgaatgcgacaatacgaataaaatgttctctaacccgaaggaccaaagaacgctcgattacatttcaggaaagtttggatgaaaaaaaacaggctgagtcagcctgtttttttatcgtgttaacgtttttacgatctttttgaaactcatgtctgattttactttaaactcgccggcacgaatttctttgtgatagccggcatcaatgacatagtcattaaagtcttgagccgaagagataatgccctctttttcaagaatagcagatacatccgcagtgctcatgccatctttaattttgagcttgtacgttttgactttgtctgttttcgtgtctgagctgctgtcatcggtcaacgatttctcttttgaatcaagaagtttttgatattcatcacggttcacagaaaccatttttttagaatcaaggtaattgttcacgtcttgttcagttactgttttattttcttttacagcagcggcctggtcttcgtcagtcagataaaaaacagctgcaagaacggctgtcgctaaaatgatgccgccagcaaatgcctgaatgccccgttttgtcatacgagcaccttctcattatctttgataatcgtattcacgtcttccactgatacatgctcagctttagcaatcgcttcagctgacataccgttattatatttagaaagtatttgtttagcgattttttgattgatgtcgttctgctttgatttgcgaatgacaaggtttgtttccagtaattcttcctcaagcactgtcattttctttttgagcttgtaaatttcctgcatcgcagaaagctgcagtgtttcgagctcctgttctacatctttcatcgggtctctttgagaatatgagaatgcaattagcgctatactgacgataaacaacgcaataatagcaatttccacgtttcatcaccttctattctttttttatccttcttttttataccataaaaccaatagtttctaaaggaattcgcgaaaaaaacgagattttgtcgagaaatctttcttcgcttcttcttcatgtaatggtttaataggaacacgaagtgaacgattggaaaggagaatgttaggagtccatggataaacacccatttccctataatatacgacataagctttccttttttagggacacattcgacataatcattcaaaacgctcacaccttgaccgtaagctgggaaatctcagaagaaacaatgcggctggctgaagcggtccttttcgaaaaaacgcaggatatgataaaagaattgcgcattgtcatcaaaagaaaagacattgaagctgtcaggacaaaacgcacaacgtatgataaaggagaatggacgattagacaggcggctggtgatgctgtatatcgggctgaatacagaattgtgaattcaatgaatgtctctctcaagcttgccggtacagacgacatctatcttgatgaaaatgggattcgtcatataaacagttttcagattgaagaagcgcacaccaggtgggaggcgcaattttctgcatacacctgttatgggagaggggaaaaagaacggtgaacattctcatgctttcacccgaacatcccgatgagccgaaaagcgggctcggtgtccatttaaaccgcctcatttcctatttaaaccctcatatccacattacggtttttactccgagcgggcagctgttttcgtatgcgaagtttgaagattacatagctgatgctaactttacaatggttcgccatgtgttatcacacaataaacgctttgatctgattcatgcccatgatgacacaactgcccctgccgcccagtatttgaaacaacggcttggccttccgcttgctgcgacaatccacggtcttgaaagcgaaaggaagaaggtgtgccgagaagccccacacccatacaggctcatgaccgaacggctccttatagaatccgctgatgcattgatcgtattaagcacatttatgaagcggtctcttgataaggcggcacataagaaaataaccgttatcccgagtcctgcatctatggagaaagagaaggggaaaatcccgagaagcatgaatagaagattcctcttttcatatggaaggtttgttccggaaaaaggattatcgcagctgttaaaggtgtttgccatcttgaagcagcgtcagcctgacctctatctagtgctggctggggaggggccgtctctgtcctgctatgagaaattggctgcggcatataacctgaaggatcgcgtcatgtttctgccgtttctcaataggaaagatatcagaacgttactgtctcactgtgaaatggctgttttccctagttcttatgaaccgtttgggcttgccgcgcaagaaagcatggaacaaggtgtgctgactgtcgtttctcggtcaggtggtttttgtgattatgcggttcatgacaaaacggcaatcatcgctgattttacgctcgtacaggaagcggctgatctgctggacagctttttaaaagaccgggagaaagcccgccggataaaagaagctggcagacaacaagtgtttaagctccaccacccccgactcattacgtcatcatatttgcagctttatgagcgtatcatcaataattcagcaattcattgaaaaacagcctagcattccgtccattatagtggtattatatataagtctgaataagtaaatgattttagtttggagggaaaataatgcgcgttaatattactttggcttgcactgaatgtggtgagcgtaactatatttctaaaaagaacaaacgcaacaatccagaccgcgttgaatttaaaaaatattgcccacgtgataaaaaatctacgttacaccgtgaaacaaaataacagctttgctgtttgaggtgtaagaaaaaagccagagctttgaaaaaggttctggctttttttctattccgagggggatgagagatgaaatcacaattaagaaaaaagacaatgcaggcactgtctgctttatcaagtgatgatctgcttcaaaaaacggaacgtatgtataagtatttgttttctctgccggagtggcaaaatgccggcaccattgcggtcaccatctccagaggattagagataccgacgcgtcctgtcattgagcaggcttgggaagaagggaaacaagtttgcatcccaaaatgccatccggacacgaagaaaatgcaatttcgcacatatcagactgatgatcagctcgaaaccgtgtacgccggactgctcgagccggtaattgaaaaaacaaaagaagtaaacccatcacaaattgacttggtgatcgttccaggtgtttgttttgatgttaacgggtttagggtcggctttggaggcggctattatgatcgctatttaagtgcatatgaagggaagacagtctctttgcttttggagtgccagttgtttgcgcacgtacccagtctgccgcatgacatcccggtacataagctgataacagaggatcggatcatttcttgtttttcataactttcctgtccctgattcgagaataaataaggtagaataacaaaccctattggcaggagggatatcatgaaaaaacttttgatatatgccattttcgcggtttctgccgtcatgttttatcaaaatcgctaccgtcttatgaatacggtactcagccagccaggaatcaggcggtcttttatccatttgtttttaagaattccatttatccgcaataagtttatacagcaagctttctaaaatcccgtgaaaaacgggattttttgctttcagtaggcgtttcggagcgccagctgttataatgaaaaaaaactattggagcggtaaacatgtttttgctggagtatacatattggaaaattgcggcgcacctggtgaatagcgggtatggcgtcatacaagccggtgagtcagatgaaatatggctggaagcgccggacaagtcctctcatgatctagttcgtctttataagcacgatcttgatttccgtcaagaaatggttagagacatcgaagagcaggccgaacgagtagaacgagtcagacatcaattgggcagacgaaggatgaagctgctgaatgtgtttttttcaacggaagcccctgttgatgactgggaagagattgcaaaaaaaacttttgagaagggaactgtgtcagttgagccggcgatcgttagaggaacgatgcttcgggatgatcttcaagcggtttttccatcatttcgtacagaagattgttcagaggaacacgcttcgtttgaaaacgcgcaaatggcgcaagaacgcttcctttcgctagtgctgaaacaagaagaacagagaaaaactgaagcggcggtttttcaaaacggaaaaccgatttttacatatttatttattgcgcttcagatcctgatgtttttcttgctcgaaataaacggaggcagcactaatacggagacgctggtcgcttttggagcaaaagaaaacagcctgattgcacaaggagaatggtggcggcttctgacaccgatcgtgcttcacatcggcatagcgcatttagcttttaatacgctggctttatggtcggttggtacagcggttgagcggatgtatggatcggggagatttttgctgatttatctggctgctggtattacgggttcgattgcgagttttgtgttcagcccgtatccttcggcaggggcatcaggagccatattcggatgcttaggtgcattactgtatgttgctttgtctaatcgaaaaatgtttttaagaaccataggaaccaatattattgtcattattatcatcaatctgggctttggttttgcagtttcgaatattgataattcaggacatatcggcggcttgattggcggctttttcgctgcagcggcattggggttgcccaaagccggagcctttggaaaaagattgttgtcagcggttttgctgattgctttggctgccggatttttatattacggattgcattcgccttcacaccaggagtcagcgctgattcagcaggcaagcgagctgtatcaggaaggaaagtatgaagaagtaacagaattactgaacggagaagcagcgcaaaaagatgcctctgccgatcttttgaaaattcttgctgtatctgatattaaaatcggcgaatatgatcaggcggttttccatttggaacgagcagtgaaaaaagaacctaaagaccatgcctcatattactatttagccttattgtatgcggaaaaaaatgagcttgcacaagcagaaaaggccatcaggctggctttaaaattggagccgaaggagcagcgctacaaggagctgcagcaacaaattgaaaacaataaagaatcataaaggtggaatacggaaaggaggctggcttttttgtcagcgttttcttcttgactgaccgcttccttatgaatacgcttatgatagttaagttcaagaaatggtgaggaaaatgaatacattttatgatgtgcagcagctgttaaaaacgtttggccacattgtttattttggagacagagagcttgaaattgagtttatgctggatgaattaaaggaattatacatgaaccacatgattgaaaaggagcagtgggccagagcggcagctgtccttcgaaaagaattggaacaaacaaaaaacggaagagatttttataaaggctaaggtgataaaaatggacgagatatggtttgcgggcattgacctgggaggaacgacgattaaactcgcttttattaatcaatatggcgaaattcagcataagtgggaagttccgactgataaaaccggcgacacgattactgtcacaattgcaaaaacaatcgacagcaagctggatgagctgcaaaaaccgaagcacatcatcaaatacatcggaatgggtgcaccaggccctgtagatatggcggcaggagtggtttatgaaacagtaaatctagggtggaaaaattatgctttgaaaaaccatctggagacagaaaccggcatcccagctgttatagaaaatgacgcgaatattgctgcgctcggggaaatgtggaagggagcgggtgatggcgcaaaagacgtcattctcgtgacgcttggcacaggagttggcggcggcatcattgcaaatggtgaaattgtacatggtataaatggcgccggcggagaaatcggccatatttgcagcatccctgaaggcggagcgccctgcaactgcggcaaaacgggctgtatcgaaacaattgcgtcagcaaccggaattgtaagaattgcaaaagaaaaaatagcaaatgctaaaaagacgacacgtttaaaagcaaccgaacaattgtcagcgcgggatgtgtttgaagcggcgggtgaaaatgatgaaattgcccttgaggtggttgattatgtagccaagcaccttggtttggtgctcggaaatttggcaagctcgcttaatccatccaaaatcgttcttggcggcggcgtatcgagagccggagaactgctgagatcaaaagtcgagaaaacattccgcaaatgcgcgtttccgcgggcagcccaagctgctgatatttcaatcgcagcacttggaaatgatgccggcgttatcggaggcgcttggatcgctaaaaatgaatggctgaaacatcaaaattgttaaaattgtgtaaatgaaattgattttttgttgtgctcaggttaagatttaatttgatgtgttaatgagaatgttgggaatagactgatttttttgagcgtgctgcataggaggttgaaatgcgaaaaacgtttttttcgaagatttcatttatgctgattgccattttattgatgtggctgaaaacgtatgctgtttacaaaaccagttttcatattaaaatcgacaatctaacacaggaatttattctgtttatcaacccattgagttttttgttgcttatttttggcctcagcctgtttttaaaaggcaaaaacagaaatcgctacattatcgcgatgagctgtcttgtcacgtttgtattgctggcaaatatggttttttaccgtttttacaatgatttcttaacaatccctgttctttttcaaacgagcaatatgggtgatctcggaagcagcatcggaacacttcttgagccgacagacctcctattagctgtagatattgcggttttaatatggcttcacatccggcaaaaagcttttcaatcggacattccctcaacgaaaaatgaacgggcggcttattttttgttcgttgcttctgtttatttcttcaacctgggcttgtctgaggcggaaaggcctcagctattgacacgctcatttgacagagaaatgcttgttaaaaacattagcctgtttaattttcatatttacgatggcgttcttcagtcaaagcaatccgcacagagagcgttggcagacagcaacagcctgacggagattgaaaactacgtaaccgctaatgcgaaggatgccaacaaacgcttattcggcgctgcaaaaggaaggaacgtcattctcgtatccttagagtcgacgcaaagcttcgtgattaatgaaaaattgaatggagaagaaatcacgccttttctgaatgactttataaaacagagctacaactttaataatgtttaccaccaaacaggccaggggaaaacctcggattctgaatttatcgtggacaattcactgtatccgcttggacgaggtgccgtattttttacgaatgcgggcaatcaatatatggccgctcctgaaattttgaaaaacagcggatactattcagcggtgctccacgctaataataagagcttttggaatcgtgatttaatgtacgactcatttggatatgattcgttttttgatattaactcgtatgatgtaactgacgaaaattcagtcggctggggacttaaggataaagaattttttgagcagtcttcagagctgatgaaaaatctgcctcagccgttttactcgaggctgattacactgacgaaccacttcccgtttgatcttgatgaagaggaccaattgattgatgaatatgattcaagcagccagacgctaaataaatattttccgacagtgcgttatcaggatgaggcgctgaaacggtttatcgaaaagctgaaggaagacgggttatacgacaactctgttattgtattatatggtgaccattatggtatatcagaaaaccataatgaagcgatggggcagtttttaagaaaagaaataaccccatttgaagaggtacagctccaaaaagtgccgctggtcattcatattccgggtattactgataaaaagccgcaaaccattgaaacagtaggcgggcagattgatatcaggccgacgctgatgaatcttttagggattgatacgaaagatcaaattcaattcggcaacgatctgctttcagacgaaaaactggacttcacggtgctccgggacgggagctttatcacagatcaggttgtttatacagacggtgcgtgttatgacaaagagacgggaaaaccgttagaagagacaaaacaatgtgaagcatttgctgataaagcaaaacaggagctatcactttctgatgaaatcatttatggggatttgttgcgattttatgaccagaaaaggctggacaattcgtcaaagcggaaagaaaaacaaatgcttgatcaggcatcataatcacaatgtctcccgcattgaagtgagcgggaggctttctttttttaaatacgctgtcatatagtaacaaaaaagggggatgatgatggcgtttattactgtgaaacctgagatcaagaacaatttggccaatgtggcgaaagaactgaagatagacgaggaattgcttaaaagtgcaaatcgctccgcacaaaaacatcaattgtattgccctggttatgtgatagaggagcatagcggcaaagagcttcaaaccattcaggacataaagcgctttttacagcctcggcagctgaaactttcagatagctggattgagcaagagaaaatctatgatgattcagctgttgaaaaggaaataaagaagattattgatgtttttccgtttgtctcatgccgggaaattggccgttctgtactcggcaggcctatctgggagctgaaggctggtggggagcatgccgtaaaaaaggtccatatgaacgcgtcatttcatgcgaatgagtggattacaacgtctgtcctgctaaaatggtttaaggaatactgtatgtcattatgctgcaattcgcctttctttggcttttctcccataaagctgtttaacagcacatccttatccctcgttcctcttgtcaatccggatggcgttgatcttgttttaaacggatcagaagtcatgggagccagaagagatgaactcgaaaggctaaatgaacatcgtccaaattttaatgaatggaaggcgaatataaacggggttgatttaaataaacaatttccatcattatgggaaattgaaaaataccgaaaaccgacagcacccagctaccgcgattttccgggaatctctccgcttacggagccggaatctattgcgatgtaccggctgatcacggagaatccgcctgacagactgctggctcttcatactcaaggagaagaaatttattggggctataaaggccttgagcctgaggaatctgctgccgtcataaaggattttgaggagttaagcgggaacatttataagggagtaagggatatagatagctatgctggatttcgtgattggtttattcaccattattttaaggaagggtatacggtggaacttggaaaaggccaaaatcctttgccgtttcagcagttttcacacatatataacgccacaagcggtatcttgtggagggcgttattttttcatgagtaactgaaactttttcttttttctgccgaagcaaatatgagagaataaagatgatcggaggggaatgctgatgagatcagtttgttttattctgctggcggtattgctgtttagtttatcggcatgcgaaccatctcatcagcagcaaaaacaggcatcggcggcaaaagatgagaaaaaagacatcataccgctttccgcggaaaaagcggatggggcggaaggctggctgaataacagcacaatattatatactgcgtctaatccgacgaaaacagagctttttgcgtaccgcatctttacaggcaaagcgaaaaagctctatcaaacggatggtcaaatcgttgatgttcaaatcaatgcgagggagcagatgattctgctgcaaatcacacatagccaaaagacggcagtggttttgcttaatgcagaaggagagacgctttacgaaaaagattacgaaacgtatgagcttgaagctgcttggaatcagtatgatccttatcaaatgatggtgacggaattcaatgaaaactgggatttccatacatatcaggtgaatgctaaaaaagacgaatctttcttaagcccagtacaggttccgttcattcattggacatccaaaaatacatttgattatgtaaaagagggaagagacgataaaacagggcctttatatacgttcgatacagcttctaagacggaacagaagcttgaggatgacgttctattcttcgattctttccatcaaatgagttttactgtcaaatcagcttccggaggaaaagggacgtatcagtttaaaacgccgcaatcaacatcacctgttacagcgaaatggccgctccaagcgaaatatacaagtttggctccaatggagtatgactatgatgaagcaggaggcctgttttatacattcaaacaaagcggcgatgcatataagctcgcagcaatcaatgtagcatcgggagagacaaaagatcttgtgtctctgcgggaaatggagccgattcaaatatctccgaacgggaaatatgcgttatacggctttcattttgagcaaattattttattgaaatcacatgaaacgaagcaactcatcattgatcaaaaggagatggaataacgatggctatcgcagatgtaaccattatcccaatcggtacggaaacacccagtgtcagtgcttacgtagccgatgtgcaaaagatattagaaggatatcaagcagaagggaaaatcaaatatcagctgacaccgatgaatacgctgatcgagggagaactcagtgacctttttgcagtcattcaggcaattcacgaagcgccatttcaaaaaggattgcacagagtggcaacgaatatccgtatcgatgacaggcgtgacaaaaaaacgacgcttgagagcaaaatagaaagtgtcaataaacatttacagccataaaaataaacctgtatccgatcggatacaggttttaatgtgcggttggatacccgctgtttattacggtcatcacggtaaaccatccaaagacaaataaggtggcaccggctaataaaaacccgagtatatttttatttctaacagaacgcaagactccccataaagcgaaaagagcgacaaggccgaaaatcacgacaagtaacataacacagccccctttacattgaaaaacctgcaattctttccagttttattctacctgttttttataggtttgtcgatagcgttttcattgcgattgtttgaatcttttttaaaaaaccctcataataagagcataaaaaagaaagaggtgataatagtgaaatggagacgaatgccagtagggccgattcaagcgaacgcatattttctcatcaatgatgatcaatgcctgatttttgatccgggcggcgagggacataaaatcaatcaatacataaaagaaaaagggctgacgcctttagccattttgcttacacatgcccattttgaccatattggggcgcttgatgaagtgagagaaaaatgggatatccctgtttacctgcatcaaaatgaaaaaaaatggcttacggacgcttctttaaacggctccggcatgctgcgagggatagaagtaacagctaagcctgcagatcatctaattgaaggcgacggtgagttgaatatcgggccgtttcatttggaaacattatttacgccgggacattcaccaggcagtgtgtcttactacgtgaaagatgcagacttggttatctccggagatgtcttgttccaaggcggtataggacgtacggatttaataggcggcaatcaagagacgctgctgacgtccattcatgaaaaactgcttacacttccggaacacacgctggtgttaagcggccatggacctgaaacagacgtactgactgagcaggaccaaaatccgtttttaaatgggttttcattgtaaaaaaagagacaaaccgataaggtttgtctctttctgcatttaatggcctccgccgccgggcaccataataaaaattgagtaatatgtaaagccggcgaagaaaattgttaaataagcgccaaaaatataaatatacatgcgttcggttaagttcaaatacgatagaaacacaaataagatcgtctgtccaaaaaataaaagggaagcatctttcatatcacctaaataaaacataactgcaaaaattcccgtccaaaatcctaacacccggaacatgcgattcatttttatcccctcccgagagtccctctgactgttattataatagatcacacctagaaatgtaaacattttcattattaatatacaaatggaatttgtccctttgattgtgttttctattgtatgaatgttttttaaaaaataatccgaaaaaagttctgtaaatggtttaaatgaaaaatgatccgggtagttattctacaaagagatggttaactgaggaggaaaaaacgaatggaacaacaattaactttttactcatatccaagctgcacgtcatgccgaaaaacaaaacattggcttaaagcacatcaaattgaatttaacgaacggcacttattcagagaaaccccgacaatagaagaattaaagtacattttatcgttaacgacagaaggaattgatgaaattttggcgacaagaagccagactttcaaaaatttaaatttaaacattgaagaaatgacggtaaatgaggtgctggaacttttaatcgagaagccgaagcttttgcgacgcccgattctagtagacaacaaaaagctggtaattggttataacccgggagaactgttgaagttatcgaagaagaaaacggttcatcaatctgcatgatgaaaaaccgaagatccgctgatttattcgaatcagcttatcttcggtttttcacctgttcagaaactgggctagctggattcgaaccaacgatcacggagtcaaagtccattgccttaccgcttggctatagcccattgaatctaaacatagtatgtgtaaaggcagacgagttatacatatatagcgtacatttttcaaaacaggagggagctcattaagatgaaagctcttgatcagcacttaacagagcacaaagaagatatcacgcaacaatggctggaagtttgtacgtcaaaaggcagctggctgtattcagcgaaagatcagcaaaaactagaacaaaagttaaaagaccagcatgaattattggtgaccatcgtagcaaaatcccttagaaaagaagacgtagaggatgagctcaaccggtggtctcttcaatgcgccagagaccgtgccgttcatgaagtgacggttacacaaagtgtcggccagtttaacactttcaggcacatcatgtttgaatggattcataaattcagcgaagcttcttctcaagacatcagcattcaggaattttatgagtggagccggatcttgaatcaaaacattgatgagatcatcgaagtgtttacggaagaatatcaccaggtgaccatgatacaattaaacgcgcaaaaagaaatgattaatgaattgagtgcgccgattatgccgattactgatggaattgggattcttccgcttgtcggtgaaattgatacgcacagagcgaggacgattttggagtctgtgctggagcagtgctcagcgttaaagctctcgtatttatttttagatatttcgggcgttcctatcgttgataccatggtagcctatcaaatttttaaagtgattgacagcaccaaattgctcggcattgagacgattatttcaggaatcaggccggaaattgcccaaactgtcgtgaagctgggtctggatttttcgaatgtgaaaaccgagcaaagtcttgctaaagccctggccaataaagggtttaaaataaaagagtgttgatgcctttgccatgtttatcttgaaagttagcagctgaacagcctttcacgggctattcagcttttttaacttctataaataaaatgtgatggctgttgatgtcttttaccttaaaagagtagccatcatattctatggtactttcaggctcagcgtctatgttttgtgtcaaaaaccagccgcccaaggtgtctacttcagcctctgataaatcggttccaagcaggctgttaacatcgctgattaataattttgcatttaacaagtaatgatcctttccaagttcgcggatatgaggcacttcatccgcatcaaattcatcacggatttctcctacaatttcctcgataatatcttcgacagtgaccaaaccggacgtcccgccatattcatctatgaggatcgccatatgagtgcgttccttttgcattttcagcagtagtttataaataggaatcgtctcaatgacatggataacgggctgtacgaaaggttcaatttgatgcttcttgattgaaaaatctttcgtcagcatggaaaacagcacttctttcatattaatcacgccaatgacgttatctttatcctctcttacaaccgggtaccgtgtatattttgtttgcttgactgtttcctgaagatttgaaatggagtcttcatctagtgacaaactaaccatttcatttcgcggcaccataatttcctttgccattcgtttatcaaaggtgaagatattattcatgtactttaattcactttttctgatctcgccgcttttatagctttcagccaataggacccgaagttcttcctctgtataagccagctcatgctctgatgccggcttcagcccaaacactcctgtaatcaatcgggcagagtggttcaacagccaaatgaatggaaacatgatcttataaaaccaaataagcggtttagcgaacaacaaggtaatgctttctgctttttgaatggcgaaactctttggcgccagctccccaataacgacatttaaatacgtaaccactaaaaatgcgatgacgagtgaaagtaggtgggtaagcgattcatttaagcctgctttatgaaaaagcggtcgaagcagagtttgcacagtcggttccccaagccatcccagtcctaaagctgcgactgtgatgcccagctgacaggctgataaatattcatcaaggtgagtgatgacatgctttgccgctttagcacctttctttccttttgcgacaagctgatcaattttggatcgccgcacttttacgattgaaaattctacggcaacgaaaaatcctgttaacaaaatgagaatagcgactgctagtaaattgataaattccaaaacaactgccttctccaaggaaggcatgcacctcccttttccgatgtctttctacattccataccacctgaaaatgctcataaaacatgtgttgaagcggcagactggtttagtgacgcggttattgggcaattaaagaataaagaacaaaagtttggaggagcttgacatgaaggcacatacgggaaaggattggttttggtaccaaatggggcctcaagaaagaagtaaggcaagagatctaatccatttttctcactggcctcagtgtgaaaagtggtttgaaaataaccaccacgttaattttttgcgagtagatacaactgaaacggaaaatgaagcggtatttgggtcgattgtttatgatcaggggcttggtgaagaaaaagaccatactgtttttcacttttatatcaccagacaatattttttcacaatcaattttgacttttcgattttgagagagattaaaggcaaagaagttgtccggcaaatggaaagagcggacaatgcgatagaggggtttttaattcttctcggcgaactaatgaatgcgtatttaatcggtgttgatgaatttgaagtaaagctgagaaagcttagatggcagattaaagacgacaatagcaaaagcattttaaaccgcgtccatctcctgcgccatgaactgatgatttggaaaaatttgatattaagcgctaaaaaaattgaaatggcgttgaaagaaacctttttacctcaaaatgaagagaaaaaggattatcagcggacacaactgaaaattgacaggggattttcatacatcagcgaatttgaaggggagcttaacaatctgctgcattcagaggaagtcattacctcacatagggggaatgaaattgtaaaagcgctgaccatttttacgacgctttttacgccgataacagctctgggtgccttatgggggatgaacttttcagtgatgccggaactgaattggaaatacggatatctcttttccctcttattgattgtcacatctacagttctgatctatctctatttgagaaaaaaaggctggacgggagatatgctgcaggagcggaagaagaaaaagaaacctcgaaaaaggcggactctataggatgtttcatattttgtgcagcgtgccccgctttttcaccagacatatcagggtgaccggatacgatgtcaaggggcttatgacagagcattaaatccgcagtttatcgattcttgaaaatgaccaaatgaccggtattgttgcattaggcgacctttccgttgagaaagatactggtcaataagcgaaaacagcataatgaaaatggaatctagcaggcatggtgaccatgtctgcttttttatttatagggaaaattataatgacaggggtacattcagttgaaagtcttttttcttgccagaaagaattggtttttcagcatataacatctcacaaaatcacgttttccctgtttgattaccttttcttctttttctacaatatgcgttgaaaggagagggaatcaaattggattcaatagaaaaggtaagcaaaaacttgattgaagaggcatatctaacaaaggcttctgatattcacattgtgccgagggagcgggacgctatcattcattttcgggtcgatcatgccttgctgaaaaaaagggacatgaaaaaagaagagtgcgtaagactgatttcacattttaaatttctttcagcaatggatataggtgaaaggcgaaagccgcaaaacggttcgcttacgttaaagctgaaagagggaaatgttcatttaagaatgtcaacgctgcccacaattaatgaagaaagcctcgtgatcagagtgatgccccaatacaatatcccttcgattgataaattgtcgctatttccgaagacaggagccacattactctcgtttctaaaacattcccatggcatgctcatttttaccgggccaactggttcagggaagactaccacactatactctctcgttcaatatgcaaaaaaacactttaatcgaaatattgtcacattagaggaccctgttgaaacaagggacgaagatgttcttcaggttcaggtgaatgaaaaagccggtgtaacttattccacaggtctgaaagcaattttgcgccatgatcccgatatgattattttaggtgagatcagagacgcggaaacagctgaaattgcggtgcgggcagcgatgacgggacatttggtactaacgagccttcatacgagagacgcaaagggcgccatttacagactgcttgaattcggtatcaatatgaatgaaatcgaacagactgtcattgcaatagcggctcagcgcttggttgatttggcttgcccgttttgtgaaaacggatgttcatcagtgtattgccgacagtcacgaaataccaggagagctagcgtttatgagcttctatacgggaaaaatcttcagcaatgtatccaggaggcaaaaggaaatcatgcaaattaccaatatcaaacgcttcgtcaaattatcagaaaaggaattgcgctcggctatttaacgacaaacaactatgaccggtgggtttatcatgaaaaagattagaaaagtctggtcattaaaggatcaagccaggttattaaagcggctcggtgaaatgactgcggggggatatacgcttctggatggattacgcctgatggaacttcagatgaataagaggcaggcggctgacttgactgatacggtcacttgtttgagggaaggggttccgttttatcaagtactaaagagtttgtcatttcataaggaagccgtaggtatttgttattttgctgaaacacatggtgaactgcctgcttccatgatccagagcggagagctgctggaacgaaaaattgcacaggcagaccagctgaaaagagtgctgcgctatccgcttttcctcatctttacggtcgctgtcatgttttatatgttacagtccatcatcattcctcagttttccggtatctatcaatcgatgaatatggaaacctcacgttcaaccgatatgctttttgctttttttcagcatattgaccttgtgatcattttgcttgttctttttacagcaggtatcggggtttattattggcttgtgtttaagaaaaaatcacctgcccggcaaatgctgatttgtatcaggattcctttggttggaaagcttgtcaagctgtttaacagctactttttttctttgcagctaagcagccttttaaaatcaggcctctcaatttatgacagccttaatgcatttaaacatcaaacgtttctccctttctaccgctgcgaggctgaacaattgattgaacggctaaaagccggtgagtcaattgaatccgctatttgtggaagccctttttatgaaactgatttatcaaaagtcatatctcacggccagctgagcggccgattggatcgggagcttttcacatacagccaattcatattacagcggctggaacacaaagctcaaaaatggacaggcatccttcagccaatgatttatggatttgttgcagcgatgatcttacttgtgtatttatctatgcttgtgcctatgtatcagatgatgaatcaaatgtgaaaggaagaggctgatgaatgagaaaggatttacacttgttgaaatgttaatcgtgctctttattatttcgattttgcttttaattacgataccgaacgtcacgaaacataaccaaaccattcaaaaaaagggctgtgaaggcttacaaaacatggttaaggcacaaatgactgcatttgagcttgatcatgaaggacaaactccgagccttgtcgatttacagtcagagggctatgtgaaaaaggatgctgtctgtccaaatgggaagcgcattatcatcaccggcggagaagttaaggttgaacattaaattaaacgaggagaaggggtttacccttttagaaagtttgcttgtgttaagccttgcctctatcctcctgattgccgtcttcaccacacttcctcctgcttatgacaatacagctgtccgacaggcagcaaggcagttgaaaaatgatattatgctcacacagcagactgctatttcccgtcaacaaagaacaaaaattttctttcataaaaaagaatatcaattagtcattggtgatacggtcattgaacgtccgtatgcaaggggactttctatagaactgctgacattaaaagaccgtttggaatttaatgagaaagggcacccgaatgcaggcggaaaaatacgagtaaatggccatgccgtatatgatataacagtttatctagggagcgggagagtcaatgtggagagaaaataaaggtttttctacaatagaaacaatgtctgcgctaagcctgtggctgtttgtgctgctgacagtcgtccccttgtgggacaagctgatagctgatgaaaaaatggcggaatcacgagaaattggctatcagatgatgaatgagagcattagcaaatatgtcatgagtggtgaaggagacgcgtcaaaaacgattacaaagaacaatcatatctatgcaatgaagtgggaggaggagggcgaatatcaaaacgtatgtatcaaagccgcagcttataaagagaaatcattttgcctcagcatcctgcagacagaatggctacacgcttcttaacgtattattttcgctctcagtctttttgctcatatcaggatcgttagctgcgattttccatctgtttttatctcgacagcaggaacatgacggtttcacacagcaagaatggatgatttcgatagaacagatgatgaatgaatgcaaggaatcacaggcagttaagacagccgagcatgggagcgtgttaatctgcaccaatctttccggacaagacatccgttttgacatttatcattcaatgataagaaaaagagtggatggcaaagggcatgttccgattttagatcatattactgccatgaaagctgatattgaaaatggtgttgttttgctgaaaattgagagtgaggaccaaaaagtgtatcaaactgcttttccagtctattcgtatttaggaggggggtgaatgtatcgtacaagagggtttatttatccagctgttctttttgtgtcagcgcttgtgctgttaatcgtgaactttgttgctgctcaatatatttcacgctgcatgtttgaaaaggaaacaaaagagttatacataggagagaatttgcttcaaaatggtacgcttctttcgattcggcacgttctagagaaacggaaaggccaggagggtacgcagcaatttccatatggacaggtttcttattacattcatgatacatcgataaaagagcaaaaagaaatcaacttaagagtgtcaacggagtcgggaacagaaagaactgcacagatcgtgtttgatcaaaaacagaaaaaactgctgagatggacagaataaaacagtgtaaagggtataaaaaaagtcatgtgagacaacacttcataataattgaatgatgaggtgatcacgtgaaaacgaatgattatgttaaatatatgacgcagcaatttgtcaaatatatagatacaccgagagatgagcgaaaagaacgaaaagaggtgcggaaagaaacaaaaacgcctgcttctcagcagtggttcggtattttaccctatggcttccggctttggctgaaacggaaaaaataaccgcaaataaacgaataaggtccttcaaaaaatggaggaccttattgatattcttctaatatggcgattttattgaccttttggctataaggatcaaatgaaatcgtcacaaaaacgccgaattcttttgacccttccctcagagttaaatggtattgcttcactgcttcatcttttcttttacggtcccatactttttgtttgaacagtacctgtgcaagcgggtaccttttttttgcttcttttacagcaatctcttcccatttggacatgtggcgggcggttacaagcggtgtttcttctgcgtgagcggctgtggtgccaaagacgagaagagatagacaaatcacacattgtttgatcatcatgctgtcaccctttctttgtttattattaccaaataataatgggatatgcatttaaattctcacataacaatcccaaaaatttcaaaaaaattgaaaaaatgagcaatactgagcaagactttgtaatatgatgaaaacattcttttaaacgaacgaaatgagcgatttcggtgtttttaaatctataaatcgttgattatactctatttgtgaagttctttaaagagaacgattgtcatatcaagttacagtgttttacaggaggtaagatatgtttcgattgtttcacaatcagcaaaaggcgaagacgaaactgaaagttctgcttatctttcagctttcagtcattttcagtctgactgccgcaatatgcttacaattttccgatgatacaagcgcagcttttcatgatattgaaacatttgatgtctcacttcaaacgtgtaaagactttcagcatacagataaaaactgccattatgataaacgctgggatcaaagtgatttgcacatatcagatcaaacggatacgaaaggcactgtatgctcacctttcgccttatttgctgtgctcgaaaatacaggtgagaaacttaagaaatcaaagtggaagtgggagcttcataagcttgaaaatgcccgcaaaccgttaaaggatgggaacgtgatcgaaaaaggatttgtctccaatcaaatcggcgattcactttataaaattgagacgaagaaaaaaatgaaacccggcatttatgcatttaaagtatataaaccggcaggctacccggcaaacggcagtacatttgagtggtcggagcctatgacgcttgcaaaatgcgatgaaaaaccgacagtccctaaaaaagaaacaaagtcggacgtcaaaaaggagaatgaaacaacacaaaaggatatacaggaaaaaacaatgaaagaagaaacatctcaagaagctgtaaccaaagaaaatgaaactcaatcagaccagaaggaaagcggggaagaggatgaaaaaagcaatgaagctgatcagtaatattctatacgtgatcatctttactcttattattgtgctgacacttgtcgtgatttcaacacgttcatccgggggagagccggcagtgtttgggtatacattgaaatcagttctgtcaggttcgatggagccggagttcaatacaggttccttaatattggtcaaagaaatcactgatgtgaaagagctccaaaaaggtgacgttattacatttatgcaggatgcaaatacggcggtcacccacagaattgttgacataacaaagcaaggagaccatttgttatttaaaacaaaaggtgataataatgcagcagctgattcagcgcctgtatcggacgaaaatgttcgcgcacaatacacaggttttcagcttccatatgccggctatatgcttcattttgccagccagccgattggaacggctgtattattgattgttcccggcgtgatgctgttagtttacgcttttgtgacgatcagcagcgccattagagaaattgaaagaaagacaaaagccttggaaacagatacaaaggacagcaccatgtctacttaacttcagttgtaaacctggcaacaggtttcgatataaaatcattcaataaaaggggagtttaccatgggtatgaaaaagaaattgagtttaggagttgcttctgcagcactaggattagcattagttggaggaggaacatgggcagcatttaacgacattaaatcaaaggatgctacttttgcatcaggtacgcttgatttatctgctaaagagaattcagcgagtgtgaacttatcaaatctaaagccgggagataagttgacaaaggatttccaatttgaaaataacggatcacttgcgatcaaagaagttttaatggcgcttaattatggagattttaaagcaaacggcggcagcaatacatctccagaagatttcctcagccagtttgaagtgacattgttgacagttggaaaagagggcggcaatggttacccgaaaaacattattttagatgatgcgaaccttaaagacttgtatttgatgtctgctaaaaatgatgtagcggctactgaaaaaatcaaaaaacaaattgaccctaaattcttacatgcaagcggtaaagtcaatgtagcaacaattgacggtaaaaccgctcctgaatatgatggtgttccaaaaacaccaactgacttcgatcaggttcaaatggaaatccaattcaaagatgataaaacaaaagatgaaaacgggcttatggttcaaaataaatatcaaggcaactccattaagcttcaattctcgttcgaagctacacagtggaacggcttgacaatcaaaaaggaccatactgataaagacggttatgtgaaagaaaatgaaaaagcgcacagcgaggataaaaattaataacagcaataaaaagagacggcccagtattcatatactgggccgtctcgatgtttattgacaaaagaggagttagtgcctctgctcaggcactactcctctttttgagattttctccatttttgataatctaaaaattcacgaaattgttttttcgataccccggatgtcatcgcatcgcgaaccaatttctcccattcactatctaattgaccatcgtattcggtttcatgtttctcatcgagcaaagtatgaaccgagacgtccagaacagcggagactttttcgagaaattgaatggaggggttcgtttgtagatttcgttctattgagcttaaataagacttcgctaccccagctttttcagctagttctgatagtgagtagcctttttctttacggtattgtttaatacgctggccaatcaatgtcatcaccttccttgtgatattatagcacattcagaaaggatttacggtatgacttctggctgccggaccaggatgagcagactttttgtttaaaagtaaatattttcgtatttcttccaggctgatatttgcctctttggcttccaccattaattcaacccattcttgatccaattcaaagtgctcttgttttgcattcttcatgcagtttctcctcctaaaatacttgtttatgtatttcagccagtccggccatgacttattgtatgcttcattagtctctggaagtcatttgccattaaatcgccagaatttttttccaatatacctttattataatcgtattttctcaaaaaaaacgagaatgatgtcgaatggtaaaaaagttagcttgaaatattattttgcagataaaacaatccgccattttcaatttcaactgatatctttggttgatacaaggttttcagcgcctgtttttctagatggtattcttctggtttttcttctatatgctcgtaaaacttatcaagcaatgtcatatcattcttccacctgttaatcgcctgttccgcccagtcggacggctcctgcatagcggatttggaaatatagttttccatacgcttaagtccgctttctggtttgatcataggtgaaatggtgaagcaatagtcacatatttgagacgtcagtgaaaactgggtcagcttgctttgaaaatcttcaattatcgttccagagactaggtgaagacctagtgacaataacttatcctttttcatgtcggactggtatgaaatcgtgacatttataccaagccaaggctgaagtgggactttagctccggctgattcaattttctcatacattctggtaaatctcccattttgtttaacagctttaaatatttgaaaaagacgcggggccccaaaatatataaattcaccatctaggtcttttggcgcattttctttatctgtaataaaagtgattttcattggattcggatcaccgcctgtcttctcgcgccaatgccagtagaaagggcggttcatgatttgtttgtccatttcaactgtaagctgcactgtcatatagcctaagccttgatcgacgatttggcagctgtttgcttgaaaaaaacgcagcagaaaatcgtgaacctcttgctgtctcactaataaaacctccttacaggctaagatcctcttttttcagcaggcagctgttttttataagacaaaaatgaggttaagttatccatttttattttcatttcttcttctgttgctgagtgatacaaaatgtcatgaaggtgctcttcaaaattgttcacttgaattttcgttaaaatatcatcaagttcaccgaccactttttcaaacaaatgaattttttcatataaaagctttagaatatgctcttccaccgtatgttttgtcgccatgttataaatatgcacgtcacgctcctgcccgagtctgtgaattcttccgattctttgctcaagccgcatcgggttccatggcaggtcatagttgatcatgtgattgcaaaattgcaggttaattccctcaccgcctgcttcagttgcaataaggacttggatttttccgcggaaaagatccttcatccagtctttttttccacgtttaaatccgcctctaaacggcacagaactgatgccgttttgctgaagaaaccactgcagataaatctgggttgcacggtattctgtaaaaatgatgaccttatcgtcgatctttttgatcaagtcaacaacttgaagcgctttagagttttgtgtcacttgattgatgcgatctatcaaaactgaaatcgtatcctcatcaatggcaggtgcttgtttctctttttgatcaagcatctttttcagcgtcatatataccgcttctctgctcgaacagcattctctttgcaaggtcataatcgagaacatgctggctggtttattgatactgtccttcaagcgagaaatttcatcataaagcgcctgctctgatggagaaaattgaatcggcactgtttcaacatggcgctgtttccaattcagccctgtatcatgccgcctgttacggatcatgactttattcacaagatcttttaaatgttcatgcgcttctaaactggatttcttcttggcgaactcctcctgaaagtgattctgactgcctaaatggccgggttttaataaggacaccaaattgaaaatctcttcgatacggttctggattggcgtcgcggtaagaagcaggcaatatttttttacgagattccggacaaattcatagttcttcgttttgctatttttcagtttgtgtgcctcatcaataatgacaagatcatatgggatagacagaacgatttctcgatggggcgagcgcttcgcggtgtctattgatgagacgacaatatcgcattgctcccacacatagcttttcttttgttcaacagccggaatcaaaaatttttcctgaagctctttgacccactgtgacacaagggaagcgggcacaaggatcaaaattttttttgctaacccgcgaatcatatattcttttagaatcagtccagcttcaaccgtttttccgagaccaacctcatctgctaaaatcgctttcccgttcattttttcaaccactttttgcgccacttcaagctggtgggggagcggcgtaaaggaaggcagatataaaggagcccgtaagccttcaaaatctggaattgctaatgttttctggatttctgcagagagcttgtacagttcccagtttgcccaagggccatcgtttttcagtctttcagcaaattcttcaggccattttgcatcgtagatcatttctgttttcattgctttgaaaccgcctttctaattcttcgattcttaagatgaacaatataagaaaaatctgcccaaattgctgttgcccagcatatagtgatgatggtaggatatgagtatgtatttgatgtaagatattgctatagtatgtccataacagcatgaaaatatgagcgaatgacagcaaggggagagacctgaccgaaaacctcgggatacaggcgccgaaggagcaaactgcggagtgaatctctcaggcaaaagaactcttgctcgacgcaactctggagagtgtttgtgcggatgcgcaaaccaccaaaggggacgtctttgcgtatgcaaagtaaactttcaggtgccaggacagagaaccttcattttacatgaggtgtttctctgtccttttttgtatgtttttagctgcgccgttgataaaggggaggaattagatgctgaacagaacgccgttatttgacctgtataaggaatatggaggaaaaacgattgatttcggaggctgggagcttcctgttcaattttcttctataaaaaaagaacacgaggctgtccgaactgcagccggtttgtttgatgtatctcatatgggagaagtcgaagtgtcagggaacgacagtctgtcttttttgcaaagattgatgacaaatgatgtttccgcgttaacgccaggccgtgctcaatatacagcgatgtgttacccggatggcggaaccgtcgatgatttgcttatctatcaaaaagaagagaaccgctatctgcttgtcattaatgcttctaatatagataaagacttggcttggatgaaagaacatgcagcaggtgatgtgcagattgacaaccagtcagatcaaatcgcgctcttggctgtacagggaccgaaagcagaagcgatcttaaaaaatctgacagatgcagatgtgtctgcattaaagccgtttgcgtttattgatgaagccgatatcagcggccgcaaagcacttatttcacgcactggctatacgggagaagacgggtatgaaatttactgccgcagtgatgatgctatgcatatttggaaaaaaatcatcgatgcaggggatgcatacggattgattccatgcggtctcggtgcacgtgatacactccggtttgaagcgaagctcccgctctacggtcaggagctgacccgggatattacaccgattgaagcaggtataggctttgctgtaaagcacaaaaaggagtctgacttttttggtaagtcagtattgagtgaacaaaaagaaaacggagcgaagcgcaaacttgtcggtctcgaaatgattgaaaaagggataccgcggcacggatatgaggttttccaaaatggcaggtctgtcggaaaggtgacaaccggcacgcagtcaccgacattaggaaaaaacgtcggccttgccttaattgattcggaaacgagtgagatcgggactgttgtagatgtagagatacgcaaaaaattagtgaaagcaaaggttgtcaaaacaccattttataaacgctaatattttttcttggagagaggagacaacacatgaagcaccgttatttgcccgcaacagaaaaggataaacaggagatgcttgctactatcggcgtaagcagcatcgatgatttatttgctgatataccggaaaacgtcaaatataaaaaagagtatcaaatcaaaaaagcgaaatcagagacagaattaacaagagaactgacaaagctggcctctaaaaatcgtgataccgtacaatacgcttctttcttaggagcgggtgtatatgaccactatcagcctgtcattgtggatcatgtcatttcgcgctctgagttttataccgcatatacgccttatcagccagagatttcacaaggagagctccaggctatttttgaattccaaacgatgatctgtgaactgacaggcatggatatcgccaactcctcgatgtatgacggcggaacagccttggcagaagcagcaatgcttgcttcaggccacacgaaaaagaaaaaaattgttgtgtcaaaaaccgtgcatcctgaatcgcgagaggtgctgaaaacgtacgcaaaaggtcagtatattgatgttgttgaagtacccgctgcggatggcgttacggatcttgatgcattgcgccaaaccgtttgcgagaacacagccgcagtgatcgttcagtacccgaattttttcggccggatcgagccgctaaaggatattgagcctatcgctcatcaagggaaatccatgtttattgtttcagccaacccgctggcgctaggtcttctcactccgccgggcaagtttcagtctgatatcgtcgtcggtgatgcgcagcctttcggcattccttcagcatacggcggcccgcattgcggcttttttgccgttactaaaaaattaatgagaaaggtgccgggccgtctcgtcggacaaacggaagacgaaaacggaaaaagaggttttgtacttaccctgcaagccagggagcagcatatccgccgggataaagcaacatcaaatatatgctccaaccaagctttaaatgcgctggcagcatcagtggccatgactgctctcggaaaaaacggcgtaaaagaaatagcccgccaaaatctcttaaaagccaactatgcaaagcaagaagcaaaaaaagcaggccttactgttatgtttgacgggccgatgtttaatgaatttgtcatcaaactggatgagccggtgagagctgtgaacaagcgtttgctggcaaaaggcatgattggcggatatgatcttgggttgacgtatccagagctggactgccatatgctgattgctgtaacagagctgagaacaaaagaagaaattgacgcactcattcaggaattgggggatcgccatgagtaatcaggaccaggcacttatttttgaactttcaagagaaggccgaatcggctatagtctgccggagctcgatgtaccggaaatcgaattgggggacctcttgtcagacacctatattcgtgacgaagacgcagcgctgccggaggtttcagagctggacatcatgcgccattatacagcgctgtccaaacgcaatcacggggtggattccggtttttatcctctcggttcttgcacgatgaaatataatccgaaaatcaatgaaaaaatcgcacgtattcctggttttgctgcgattcatccccttcaggatgaagacacggtgcaaggcgcattagagcttttatatgatttaagcaagcaccttgaagaaataacgggaatggatgaggttacgcttcagcctgctgccggagcgcacggcgaatggacggggctgatgatgatccgtgcctatcatgaagctcgcggggatttcaaacggacgaaggtcattgtccctgattccgcgcatgggacgaatcctgcatcagcgacagtagcaggctttgaaacagttacggtgaaatcgaatgaaaaagggcttgttgatttagaggatttaaaaagagcagtgaatgaagaaactgcagctcttatgctgacgaatccgaacacgctcggcttgtttgaggagcagattacagagatggcggaaattgtacaccaagcgggggggaaactgtattatgacggagctaatttaaatgccgttttaagcaaggcgagacctggtgatatgggatttgacgtggtgcacctcaacctgcataaaacattcacaggccctcatggcggcggaggcccgggctcaggccctgtcggcgtaaaacaagatctgattccttatttgccaaagccagttttagtcaaaaaagaagggcgctttacgtttgattatgaccgccctcatgcgatcggccgtgtgaagccgtattacggcaactttggcattaatgtgagagcgtatacgtatattcgctccatggggcctgacggattaaaggctgttactgagaacgcagtgttaaacgccaactatatgatgagaaaactcgcgccttattacgatcttccgtttgaccgccattgcaagcatgaatttgtattatcagggaagcggcagaaaaagctgggagtgcgtacgcttgatattgcaaaacggctgcttgatttcggctatcatccgccgacgatttatttcccgcttaatgttgaagaatgcatcatgatcgagccgacagagaccgaatcaaaggaaacactggacgcgtttattgatgctatgattcaaatcgcaaaagaagcggaggagaatccggaacttgttcaggaggccccgcatacaacgattgtaaaaagaatggatgaaacaaaagcggcgagacacccggtgctcagatacgaggcggaagaaagataaataaaaacagctgtctaccagacagctgtttgctttatttcttcgctttaatctttccgccccattttttaaagccgccttttaggttgtaaatctcagtgcagccgtttttgcgcagggtttgtgccgcgcgtccgctgcggacactgttttggcagtacaggtaaacaggcttgtccgtacggatctcattttttctctgtttcagctgggaaagcgggatgttgcgggcgcctaaaatatgtccgccctcaaactcatttggctcacgaacatcaataagctgcgctttgcggtaacccgcgcggaattcttcttcggtaagtgttttcataattcgctgctgatagacatatgaagcaatcatatagatgataaatgcagcaaaaataatcaaaacgatcatattagacaatgtgattctactcctttagcatataaaatcaaaaccctgcttcataaaacaaggtcatagagccgttttcgacaaatactattatagtaaagcacagcgtgattgtcatctataatggaactaaaatatttttcattttcccgacagtttgataaactgattctattaaaacggtaaggaaggtcttaaaatgcaaaaagaaacttggcggtttatagactcaggcaatgcaagtcctgcattcaatatggcgcttgatgaagcgcttttatattggcacagcgaaaagaaaatccccccggttatccgtttttacggctggaatccggcgacactttctgtagggtattttcaaaatattaaaaaggaaatcaattttgaagcagtacataaatataatctcggattcgtcagacgcccgaccggcgggagaggtgtgctgcacgatcaggaactgacatacagcgtaattgtttcggaagagcaccccgagatgccggcgactgttactgaggcttaccgggttatttcagaaggcatacttcaaggctttagaaatctcggtctggacgcttactttgccatcccgagaactgaaaaagaaaaagaaagcttaaaaaatccgcggtcatctgtttgttttgacgcgccttcgtggtatgagctagtggttgaggggcgcaaggtggcgggaagcgcgcaaacgagacaaaaaggcgtgattcttcagcatggctccattcttcttgatttagatgaggacaagctgttcgatctgttcttatatccaagtgaaagagtaagagagcggatgcagcgcaatttcaaaaataaagcggttgccattaatgaactcaccgaaaagcgggtgacgatggatgaggctcgtaaagcctttaaagaaggatttgaaacaggtcttaacattcatttggagccatatgaactttctcaggaagagcttgattttgttcatcacttggctgaaacaaagtacgcttcagatgaatggaattataagcggtaaacagggcttttgacccgcggagcatccttgttttttcaagttcattagtgtaaacttgtaatggtttataaagttaaggtgctttttgggagggtttcgatgacaacaccaagtatggaagattatattgaacagatttatatgctgattgaagaaaaaggatatgcacgagtttccgatatcgcggaagcattggcagtccatccctcctctgtaacaaaaatggttcaaaaactagataaagacgaatatttaatttatgaaaaatatcgcggtctcgtgttaacgtctaaagggaaaaaaataggcaaacggctggtatacagacatgaattgcttgagcagtttttaagaatcattggtgttgatgaagagaaaatatataacgatgtcgaaggaatcgaacatcatttaagctggaacagtattgatcgcatcggggatcttgttcaatattttgaagaagatgatgcccgtaaaaaagatctgaaatcaatccaaaagaaaacagaacatcataatcagtaaaaaggcggtctcgaaggaggccgtcttttttgatacgctgacgccacccgtcattagttggtctatttctgcgcgtgttttcttaaaatggtaataaacgatcggatggagggggagggaatgagatgtatattgacggtgtgttttccggcggaggagtaaaaggcattgcgctcgcaggcgcttatgaagtgcttgaggaaaaaggcttccgctttaaaagagttgcgggtacaagcgccggcgccattattgccgctttcattgcgtcaggttacaccagtaaggaaatccacgctttaattgaagaagtggacggagagaaattgctggatcagaggtactcatttctccccttaaagatgctccagtgggtgtccatctactggcgtcttggcttatacaaaggcgatacgatagaaaaatggattgctgatctgttaagagcgaaaggcataagggttttcggcgatttgcagaaagggtctctgcgccttattgcttctgatctgacaaacggcaccatgattgttttgccggacgatttggcccgttacgggttaaatccagatatgttcccggttgccagagcggtcagaatgagctgcagcatcccgtatttctttgaaccgataaaattaaaaacggacacaggcaccgccacggttgtcgacggaggcgtgttaagcaattttccaatctggctgttctcaaaggaaagaaagcgccctgtgatcggtgtcacgcttgcgccacgtgaaagagagcgtccgaaaaaaaatatccgcaacgcttttgaactgttcggcgccctgtttgaaacgatgaaggatgcccatgacgcaaggcacattgcgtcacgctatgaacaaaatatcatttttcttcctgtcgatgacgtaatggcaactgattttcatttaacacaacaaaaaaaactagccctgattgagctaggtaaaagacggacagagctgtttttaaagcagtggacctattaaaaaagcgctctgtttttctttttattttttttcccttctataacagtcagctgagtctggctttttttcttgagaatcatcggcttaggcttgctggcgctcggaacgcttcgcaggtggctgacacgtcccttatgtccggcgcggtgttttgctttatgttctttcatccggcgccgcgattgtttcgccgcttttttgaaggctgctccttcgctgcccgcatttcgattcattacatatttcacaataaaataaataatgatacctgccacgatgacggttaccgccatttttgccatttctccgggattggttaccagcacatagaggaaaccgaacgctcccagcgcaattaatacagcaataataggttgtacacgatgattcataactgtccacctccgaaagtaatagcagggcaacggattttagatgacgttgtgagaaggcttctgattttgctcagacaatgcttcgagtctgagaagttcgttaaagctttcgatggcaacttcaacctgttcatccttaggttcctttgtggttaacagctgaagccacagtcccgggtacccaagtaatttcagaccgggaatgtcacgcactttgttggtcagctgcagaacttcaaaggatataccaagcacgaccggtatcagtgcgacacgatctataacacgcagccaaagcggatctgtcggaacgagtaaataaacaaacatgccgacaataatcgtaaataaaataaagcttgatccgcagcggtaatgaagccgagattggttttggacgttctccacagtaattggcaaattctgttcataacagtttatgactttatgttcggctccatgatattgaaacactcttttaataagcggtgtcatggacaaaaaatagatgtaaccgagcagcaaaatcaacttaaacaggctttcaaccgcgatttgcgccgtgtccgaggaaaaaatcggccttgtcagttcagctaagaaaactggaaccaatgtaaatacgaatttactgaacaaaaatgataggacgcctataactgcgaggctgagatacatagacagcccggaggattttttttcttcctgctcaagtgtctcgtcttcagatggatcgagcccgtaacgttcgcttgaaaaattcaaatgctttgtgccgtttgcactcgcttcgataatggccgcgatcccccgtaaaaacgggatctttttcacgatgttcagtttcgggttgtgtttgcgtggaagcttaaaaaagtcaatgcttccatccgttcttctgatggctgtaacgtaatgatgctttccgccaaacataacgccttccacaacagcctgcccgccgtaagcgggcggaactttatgttttgacatattatcaacctgcctatttctttaggattgctaaccatttcctttcactctattgtacaggaaacagcgctaaacctctagattgacaggctgaaaaaattgccatagccttgctttttctacatgcattatacccgttattttcaaattttactcgcagctgtcaaaaagtgtgagcttttttattgacatttctttttttgggcacactttaactggaggtgccatgatgacaagcgaaaaagatacagaacaaaatgaagaattgaatgagaagcaaaagccgcctgtttcaatggccggcagggcggcggcaacaggtttttgcggaggcgtactttggagtttcgttgcttatatcgcatatttgtttcatttttccgaaatcagcccgaatatgatattgcagccgtttgtgctcggagagtggaaaaaacatgggctgggaacggtaatcagcatcattttgattggagtaatttcaattggcgcagcatttctttattttcttctattgaaacgtttaaaaacaatgtggccgggtattttatacggcttggtgctttggctgctcgtgttttttgtttttaatccgatttttccagatgtgcgcacggtgaccgaactgacatcagatacaattattacgaccatttgcatttatttgctttacgggctgtttgtcgggtattccatttcatttgaatacaatgagctgaattcggaaaagcttgcacgtgcgctgggaatgcatagagaatagtgtataatccttttccagtatgataaaatgttcacgagaagtgaacattttttacatgagaaaccctcgcaaaaaggagagattatgtgcctcattttttgattttgaacggaccgaatgttaaccggcttgggagtcgtgagcctgaagtattcggccgccagacactgaccgatattgaaacagatctttttcagtttgctgaagccttacatatccagctcactttcttccagtctaatcacgaaggtgatttgatagatgcgatacatgaggctgaggagcaatacagcgggattgttctgaaccccggcgccctgagtcattacagctatgcgatcagggatgctgtttcaagcatcagtcttcctgtggtagaggtgcatttatcaaacttatacgccagggaagaattcaggcatcagtcggttatcgctcctgttgcgaaagggcagattgtcggtcttggagctgaaggctacaagcttgctgttcgctacttattaagccagcaagggggagaatcaagatgaagctagagaaattaagaaacctgtttggacagctgggaattgacggcatgctgattacaagcagcacgaatgtacgctatatgacagggtttacaggttcggcgggtttggctgttatatcgggtgacaaagcagcgtttattacggattttcgttatactgagcaggcgaaggttcaggtaaagggttttgagatcattgaacatggcggcagcttgattcagaccactgccgacactgttgaatcgtttggcatcaagcgtctcggctttgaacagaacagcatgacatatggcacttacgcttcatacagcgccgttatcagtgatgccgaattagtgcctgtggctgaatccgtggaaaagttgcgcttgattaagtctagtgaagagattaagatattagaggaagctgcgaagattgcagatgatgccttcagacatatcttgacgtttatgaaacccggcatttctgaaatcgctgttgccaatgagctggagttttatatgagaagccagggagcagacagctcttcttttgatatgattgtcgcctcaggccttcgttcaagccttccgcacggtgtggccagtgacaaactgattgaaagcggagaccttgttacgcttgattttggcgcttattataaaggatattgttctgatattacccggacggtcgctgtaggtcagcccagtgatcaattgaaggagatctatcaggttgtatttgatgctcaggcgcttggcgtcgcacatattaagccgggaatgacaggaaaagaggctgacgccctcacaagggatcatattgctgcaaaaggctacggtgactatttcggccattcaaccgggcacgggctcggcatggaagttcatgaatcgccgggattatccgtcagatcttcagctatccttgaaccgggtatggtggtcacagtggagccgggcatttacataccagaaacaggcggtgtccgcattgaagatgacatcgtgattacagaaaacggcaaccggacaatcacccattccccaaaagaacttattattttgtgattggaatataggaggacattaaacatgatttcagttaacgatttccgtacaggattaacaattgaagtagatggcggcatttggcgcgtcgttgacttccagcacgtaaaacctggaaaaggtgcggcatttgtccgctctaaactccgcaaccttcgcactggcgccattcaggaaaaaacattccgcgctggtgaaaaagtagcgaaagcgcaaatcgaaaccaaaacaatgcaatatctatatgcaaacggagatcagcacgtatttatggatacttcttcttatgagcagcttgaactgagcgcaactcaaatcgaagaagaattaaaatacctgctagaaaacatgtctgtgcatatcatgatgtaccaggatgaaacacttggtatcgaacttccaaacacagttgagctgaaagttgttgaaactgaacctggtattaaaggtgatacagcgtcaggcggtacaaaacctgcgaaaactgaaaccgggcttgttgtaaacgtgccgttctttgtgaatgaaggcgacacacttgttgtcaatacatcagacggttcttacgtttcaagagcatagaaagaaaaaaagaagtctgttcccaaatgggagcaggctttttttttgtgcccaaaaacagaatctttcttttatacgaaaatgacaagactacttcagcaagctagagcatatcatataaaaaaatgggaggttgggagagtgctatgaaatttttacttggaaatatcaattctactgttttaacaatggcgggattacgagttttatcctctatgattgagctgacggcagcaattgtcatgcttgtgaccaacgatgtccggaaggcggttgtggttaacagcattctcgctattgtcggtccgttgatttttatcattacgatgactgtcggaatctaccaaattgccgggcagctttcgtatgcaaagctgattctgatttttacgggtgttgttttgattttggcgggtgttcataaataaagagaggcttgtcataaagtctgcctcacatcatacattttaaagaagccaatcggtagaaaggaggaggctctgttgaatgaaatcgctgaggttctccctgaatccatgaaaagcgccctttctgaaataccggaacaacaatggctggaaatcgaagaagtcagaattcggatcaaccgccctgttgaattgattcgaagaggacaacctgtgtatttgtcctatgcgggcacggccgaggatgcccatctgatcctgagccggctcagcaactatagtatgtatacacttgaagaagagctgaagaaagggtatgtcacgatcagaggcggccacagagtcggactggcgggcagagtgattacggaaaacggaggtgtgaaaggcctccgtgacatcgcatcttttaatatacgaattgcccggcaaaagctggggattgcggagccgctgcttccatacttatatcaaagcagctggctgaatacgctgattatcggaccgccccaaaccggcaaaacaacacttctccgggaccttgcgaggctctcaagcaccggcaaaaaacccatgctgcccgtaaagacaggaatcgtcgatgaacggtcagaaattgccggatgtcttcgcggtattccgcagcatcaatttggtcagagaattgacgtgttagacgcctgtccaaaagctgaagggctgatgatgatgattcgatccatgagccctgaggtgatgattgtcgatgaaatcgggcgtatggaagatacagatgcacttctggaggcgctgcatgccggtgtttcagtaatcgtatcggcgcatggctggagtatatccgacctgatgaagcggccttcattgaagcgtttgtgggaagaaagagcctttgaccgctatttggaattatcaagagcaaaagggccgggcacagtgagccaaatttatgacaaagacggaaatgtgctgtctaggacgacgggcgtgaaaacatgctgaagctgctgggcgctgtattcattgtggtagcgacaacatggacaggttttgagatggcgaagatttatacagaacggccgcggcaaatccgccagctgcgtgcggcgcttcaatccctcgaggctgaaatcatgtacggccatacaccgcttcatactgcttcacagcagattgccaaacagctcgcacagcctgtttcagctcttttttccgcattcagtgatcagctggacaagggaagtgattccgcgaaaacggcgtgggagcaaagcttaaagaaggtatgggacaccctgtctttgaaaaaaagcgaatacgaagtgctgaagcagtttggcgagacgcttgggattcatgatcgaatctcacagcaaaagcacatcaagctggcgctgacacatttggaagcctcagaagcggatgctgagcaggcgcaagcgaaaaacgaaaagatgataaaaagtttgggctttttagcgggcttgttactcattcttctattgatgtaaacgtgaggggagcaaaaataaaatgggagtagacgtgaatgtcatatttcaaatcgccggagtgggaatcgtggtcgcttttttacacacgatattggatcagatgggcaagaaagaatatgctcagtgggtgacgctgttaggttttatctatattttatttatggtcgccacgattgtagatgacctatttaaaaagataaaagctgtgtttttattccaaggataggggggcttgcagattgacattgttcaaattgtaggtttagggctgatcgccaccttcctttctttaattgtaaaagaacaaaagccgacttttgcgtttttaatcgtcgtttttgccggatgtgccatttttctttatttggtagaccaaatctacgacattattcgaatgatagaaaaaattgcgattaatgcaaatgtcaacatggtctatgttgaaaccattttaaagattatcggaatcgcctatattgctgaattcggggcacagctcacaaaagatgccggtcaaggagccatcgcctcgaaaatagaattggcggggaaaattttaatactcgtaatggctgtgcctattttaaccgtcattatcgaaacgattctcggacttataccttctatgtcataaccgaaaggaggcggtagattgaagcgctttcaatgggttttgcttttggccgtgctgatcatagcaggccgtgcagaaattgtacaagcagctggtaatgcagaacaaacggaagaccatgctgaaacagccgagcaattagcggaaaggacagcagcctcgcttgaaacagataagatcggggaattttggaatgacattatgacagaatacggcggactgctgccggaaagccaaaaaggcagcttaatggagtttatcaatggcgataaatcattctcaccgcaagaatggctgaaagctctcttttcttatttgtttcatgaagtgcttgccaacggaaagctgctgggcacattgattttgctcacgattttttgcgtcattctgcagcttttgcaaaatgcttttcagcaaagcaccgtcagtaaggtcgcttactcaattgtgtacatggtgctgattatccttgcgcttaatagctttcatgtggcaattaactatgcaactgaggcgattcagacgatgaccagctttatcctggcgctcattccgctcctcttggcgcttttggcttcctcaggcggagctgtatctgctgccttctttcatcctgttatcctcttcctgatgaacacgagcggtctcttgattcagaatatcgtcatgccgctgatttttttatcagcgattctgagcattgtcagcacgatgactgaacaatacaaagtaacgcagctggccaacctgctcagaaatatcgccatcggagcactggctgtttttcttaccatctttctcggcgtcatctctgttcagggagcctcagctgcagtgacagacggcattacgctcaggacggctaaatttataaccggaaattttattcctgtgcttggccgaatgtttacagacgcaacagatacagtaatcagcgcctctttactgctgaaaaatacggtagggattctcggtgtcgctattttgatctgtattgcggcatttccggcaatcaaagtgctttccctcgcttttatttataagctggcagccgcgattcttcagccactaggaggcgggcccgtcatcacctgcctcgacgtcatcagcaaaagcgtcatttatatttttgcagctctcgccattgtgtctctcatgttttttttaagccttactgtcataatcacagccggaaacctcacgatgatgatgaaatgaaggaggcaggcgaatgagttttttaacggaatggcttaccaccatcgtgttgtttatcctatttgcaattgtgattgatatgctgctgccgagctccagcatgcaaaagtacgcaaaaatggtagtcagcctgctcttgattgtcgtcatgcttacgccgatttttaaacttttcaagacagaccccgaagtcatctttgaatacctcacaaaaaacgggcagtcagagtctgccgacataaaaaatcaaatcaattcaaaaaaaatagaaatacaagcttcccagcgcgcatatattctagaagaaatggctgtccaactaaaaaagaaagcggaggagagattcagtcatgatgaatataaagtaggccgcatcaaactcacggcaggagaaaaggtagattcagaagaggatattaaaacaatcagcgtgtatatggccccgtcttctgaaaaaacggtccaaacggtcgcgccggtccacattgatacagatcatgcatacgtaacaaaagaagcagccgaacaaaaagaagccaaacagatacaaacgcagctcgcggacatttgggaaatcggaagtgagaaaattacggttcatatggaaggcggggagagtgtcggcaatgaataaaaacggattatggaatgtattgaaaaagcagtttcttccgggacaaacgaaggacggcgaaaagccgaagctgaccaaatatcattactttctattcgtttttgttctcggagtttcctttatgcttgtcagccagctgttttcttcacctgagaaaacagaaaacgccaaaacgataacgaccgtatcatcgcaacattccgcagacagcaaagagaaaacagctgaagtgtttaaagcctcaaaatctgataaacctaaagactcgatcgatgactatgaaaaagaatacgaaaatcagctgaaagaaattcttgaaacaatcattggtgtggacgatgtctcggttgtcgtgaatgtagatgcaacgtcgctgaaagtatacgaaaaaaacaaatcaaacaaaaatacaaccaccgaagaaactgacaaagaaggcggaacaagaagcgttacagaccaaacatcggaggaagaaatcgtcatgatcaaaaacggcgataaagaaacacctgtcgtcgttcaaacgaaaaaacctgatatacgcggtgtactcgttgttgctcagggagtggacaacgttcaaataaaacaaaccattatcgaagcggtgacacgggtcctggatgttccaagccaccgggttgcggttgcccctaaaaaaataaaggaggattcataaatgcttaaaaaacaaaccgtttggctattaacaatgcttagtcttgtcgtggtgttaagcgtctactatatcatgtcgccggaaagcaaaaacgccgtgcagatgcaaagtgaaaaaagcgcgtctgacagcggagaggtcgcaactgaaaaagcgcctgccaagcaagacacgaaggaaaaaagcggtacagaaactgaaaaaggaaaagaagatggaacaaagggaacgaaagattcatcagcagacaaggaaacatccgctgaagccagtgaaaaaggaactgttgttacggaaacagccgatgatgatttgtttacaacgtaccgtcttgatttagaagatgccagaagcaaagaaagagaagagctgaatgccattgtatcaagcgatgatgcaacagccaaggagaaaagcgaagcatacgataaaatgacggctctcagtgaagtggaaggaacagaaaaacagctggaaacgctgattaaaacacaaggttacgaggatgcgctcgttaatgctgaaggagataaaatcaatattacagtcaaatcagacaaacactcaaaatcgaaggcgacagccattatagaccttgtggcaaaagaaatcaaaacaatgaaagatgtcgctgtcacatttgaaccatccaagtaagaaagaggaaaaagaagcccgctaaacaagcgggctttttgcgttgctgtcatattagagttgaattcaaaagtccgctcctgtaagatgaacatagtatgtacttttagtagtaacctataaaaaagaaatttcatacataggagtgcgattgaatgttaaatatcaaagaaatccacgagctgattaaagcaattgacgagtctacaattgacgaattcgtatatgaaaatgaaggtgtatccttaaaactgaaaaaacacgaagcaggcacggttcaagtcatgcagcaggcaccggcagcacctgtacaagcacaggctccgcaggcagttcagccgcaagcgcagcaagcagcggcacctgcccaagaagcaccaaagcaagatgaggatctgcataaaatcacttcaccaatggtaggaacattttatgcttcttcatcaccggaagctggcccgtatgtaacagccggttcaaaagtaaatgaaaacacagttgtctgcattgtagaagcgatgaagcttttcaacgaaatcgaagcagaagtgaaaggcgaaatcgttgaagtattagtagaaaacggccagctggtcgaatacggacaacctctatttcttgtaaaagcggagtaaggagactgaacatgattaaaaagctattgatcgccaacagaggagaaattgctgtcagaatcatcagagcctgcagagagctcggaattgagactgtcgctgtttattcagaagctgataaagatgcccttcatgttcaaatggccgatgaagctttttgtatcggaccgaaagcatcaaaagacagctatttaaacgttacaaatattgtgagtgttgcaaagctgactggcacggacgccattcatccgggatacggatttttagctgaaaatgctgatttcgctgaattatgtgaagaagtgaatgtcacgtttgtcggccctagcgctgacgccatttcaaaaatgggaacaaaagacgttgcgcgggaaacgatgaaacaggccggcgtgccaatcgtaccgggttcacagggaattatagaaaatgtggaagaagcggtttcgcttgctaatgaaattgggtatcctgtaattataaaagccaccgcaggcggaggcggaaaaggaattagggttgcccgcactgaagaggaattgattaatggcattaagattacacagcaggaagcggcaactgcatttgggaatccaggtgtatacatcgaaaaatacatagaagattttcgccacgttgagatccaagtgcttgctgataactacggaaatacgatccatttgggcgaacgcgactgctcgatccaaagacgcctgcaaaagcttttggaagaatcaccatctcctgcccttgattcagaaatcaggaagcaaatgggagatgcagcggtaaaggctgccaaagcggttggctatacaggtgctggaacagttgaatttatctatgactacaatgaacagcgctattacttcatggaaatgaacacgagaattcaggtagagcacccagtcacagaaatggtgacgggaactgacctgatcaaggaacaaatcaaagtggcatcaggaatggaactgagcctcaagcaagaagatgttgaatttgaaggctgggccatcgaatgccgaatcaacgcagaaaacccaagtaaaaatttcatgccgtcacctggtgaaattaaaatgtacctgcctcctggcggtcttggtgtccgtgtcgattcagctgcgtaccctggctattccatcccaccgtactatgacagcatgattgcaaaggtcatcacatacggaaaaacgagggatgaagcgattgcccgcatgaagcgcgcattgagcgaattcgtcatcgaaggcattgagacaacaatccctttccatttaaaactgcttgaacacgaaacatttgtgagcggagagtttaatacgaaatttttagaaacatatgatgtaatgggctcataatttttacggaggtgaattgaatgaaagacaacagcttgcttaaaatggatcacgaagatacgcatttgggtaaggttgagattgcaccggaggtcattgaggtcattgccggcattgcagcatcagaagttgatggagttgccgaaatgcgcggaaactttgcgacaggcgtcgtcgagcgctttggcaaagtgaatcatggcaaaggtgtcaaagtcgacctggcggatgacggaattacgatcgatgtatactgtgtcgttacatttggcgtttcgattccgaaagttgcagcatccgttcaggaaaacattcgtcaaaccttattaaatatgacgtctctttcgattaacgagatcaatattcacatcgtcggcattcaatttgacacaaaagcccaagaagtccaaatcgacgaagaaatgtaaatggcttaacacgaaaccaaggggagggcggccctttggtttttttacacgttaccctttatttcaaagcatgaagaaagccggcttacatagccgagtttcttcatgaacgtgaaatccgaataatcatattaaggtgtgtgaaaatattcggcaatagggtaaaaaaccttgatttcaatatgcggatacgaaaaaaatatgttatgatctctttgtggcttaacgacaagcggataaagaggatcaaaggagaaagaaaatgaaaagaagaacagcaagagaaaaagctttgcaggcactatttcaaattgatgtcagcgatattgcagtgaatgaagccatagaacacgcactggatgaagaaaaaacagatcctttctttgaacagcttgtacacggggtattggaacaccaagaccagctggatgaaatgatctccaagcatctggtgaattggaagctcgatcggattgccaatgttgaccgtgcgattttgcgcctggcagcatatgaaatggcatatgccgaagacattccggttaatgtctccatgaacgaagcgattgagctggcaaaacggtttggtgatgacaaagcgacaaagtttgtaaacggggttctttctaacattaaatctgatattgaacaatcataggaggaaagaaaatgactgcaacaatcatcgacggaaaagaaacggctagagaaaaacgcgaacaattggcaaaagaggtagaagagcttaaaaagcaaggcgtcactcccggactggcggttattttgattggagatgatcctgcttctcactcttacgtgcgaggaaagaaaaaagcggcagaaacaatgggaatgaatttcaagctcgatcaatttgacagcagcctcacagaagctgaactgctttccattattgatcaatataaccaagaccctgagtttcatggcattctcgttcagcttccgctcccagaccatatttctgaaaaagcggtgatcgaacgtatctctcctgataaagatgtagacggttttcatccgttaaacgtagggaaaatgctgcttggcgaagatacgtttcttccttgcacgcctcatggaattgttgagcttttgaagaaaaccaatattgacctttccggtaaagaggttgttgtagtcggccgaagcaacattgtcggcaaacctgtcggccagcttttattaaatgaaaacgcgacggttacttactgtcattcaagaacagaaaatattactgaacatacgaaaaaagcggacatcctggtggtggcagtcggcagagccaacttcatcagtgcagaccagatcaaagagggcgctgttgtcattgacgtcggcgttaaccgtctggaaaacggaaagctttgcggagacgttgaatttgaaggggcaaaggaaaaagcgtccttcatcacgccggttccgggcggagtaggtccgatgaccatcacgatgcttgcgcataatactgttaaatctgcgaaacgtacgttatcatagataattggagatattcacaggcgaaatgtttacccgccttgaatatgagcacgatacccgcttcttcaggctcctaaagccagggcgggttttctttagttatggtgcaggaatgcttaggagaggagtttttagacatgggtgaagcagcgtatgtgaccgtctcagcgctgacaaagtatataaaacgaaaattcgatgtagatcctcaccttgaaaatatttggattagaggcgaattgtcgaatgtaaagatacacacacgagggcatatttatttcactttaaaagacgaaaacgcaagaatgcagtcggtgatgttcgcgagacaaagcgagcgtctgccttttaaacctgaaaacggaatgaaagtgctggtcagaggcggaatttccgtatatgaaccgagcggaaactatcaattatatgccaaagaaatgcagcctgacggggttggagcgctttatttagcgtacgaagaattaaaaaagaagcttgccggagaaggtttatttgacgaccgctacaaaaaacaaatccccgcatttccagccacaatcggggttgtgacatctccaacgggtgccgctgtcagagacgttattacaactctaaaaagaagatatccccttgtaaaagtcattgttcttccagcgctcgtacaaggtgaaaatgcgagcagatccatcgttacgcgcattgaagaggcaaatgaaaaagagatttgcgacgtattaattgtcgggagaggcggcggttcgatagaagaactgtgggcattcaatgaagaaattgtagcacgcgccatctttgcttccaatattccgattatatcggcagtcggacatgagacggattttacgatcagtgattttgtcgccgatatcagagccgcgacgccgacaggagcagctgagattgctgtgcctcataccactgatttaatcgaacgcacaaaaacagcggaagtcagaatgacaagagcaatgcagcagcacctcggccagaaaaaagaacggattcaaacgctgcaatcgtcctatgcctttcgttttccaaagcgtttgtatgcgcaaaaagagcagcagtttgacctcgcgtaccagcagtttcaagcacagctgaccgctcttttagatcggaaaagcagacagctggagcgtgaaacgtacagattagaggcactgcatcctcatgaacagctgaaacaagcgagaacacgataccaggaacaaacaaatcagctgagaaaaaatatgaatatccaaatgaagcagctgcattcccaatttcaaaccgttcttggcaagctgaatgcactaagtcctcttcaagtgatggaaagaggatacagcttggcttataaagaagataaactcattaaaagtgtcagtcaaatagaagagcaggaccggcttgaagtcaagctgaaggatggcgtgctgacctgtgaagtattagaaaagagaggggaagaaaaatgacagacgtgaaaaaaaatgaaaacatgacatttgaagaagcgatgaaagggcttgagagcattgtatcaaagcttgaagagggagatgtgcctctagagcaagccattaactatttccaagaaggcatggctctgtcaaaaatgtgccatgaaaagctgcaaaaagtcgaaaagcaaatggacttcattttaaaagaagacggcgaactggcacctttcagtgttcaggaggaagacgaaggtgacaaataaattaacgagctttctggcggaccggaaaaaaacaattgaaaatcagctttctgtctatacagaaaagcttgatatgccggactcattaaagaaatctatgctgtattctctacaggccggcggaaagcggttgcggcctctgattgtactggctgttttaaatgcatatggaaaaagcgaaaaagacggcattccggtgggctgtgctgtcgaaatgattcacacgtattcgttaattcatgatgatcttccatgcatggatgatgacgatttgcgccgcgggaagccgacaaaccataaagtgtttggtgaagcgacggcagtattagcgggtgacgggctgctcacagaaagctttaagctgattacctcccacgtgtcagacgaggtgtcagcagaaaagcgcctgcggcttgtgaatgaactgatttcagcggcaggcaccgaaggcatggtcggtgggcaagtagctgatatggaagcggaaaaccgacaagtcacgcttgaagagctcgaatccattcatgaacggaaaactgccaagctccttggcttttgtgtaatcgccggtgctattttggctgatgcgcctgaggaagacattgaaacactgcgtaccttcagcagccacattggaatcggatttcaaatcagagacgatattttagatttagaaggcagtgaagagaaaatcggcaaacgtgtcggctcggataccacaaatgacaaatcgacatacccgtcgcttctttcattggaaggggccaaacataaattggatgttcatataaaagaggcgaagcgattgatcggcggactctctcttcaaaaagaccttttatatgagctttgtgatttaattgcggcaagagatcactaaaacgatcctaatttgaagcggctgcacgaggtatggtaaaatgtaagcagtttatatgaaaaatgaaaaggaaaagcgcgtttgtctttttttatgtctgagattattgtcagctcggcatgcaaaagacatgtatcattgcagaaattcatgctgaaagtgagttgatccgctttggatcttttatcaatacaggacccgtcgtttttaaaaaacatgtccattgatgaattagagaaattaagtgatgaaatccgtcagtttttaattacaagtttatccgcttccggcggccacatcggcccaaacttaggtgtcgtagagcttactgttgccctgcataaggaatttaacagcccgaaagacaaatttttatgggatgtaggccatcagtcgtatgtccataagctgctgacaggacgcggaaaagaatttgcgacgcttcgccagtacaaagggctttgcggatttccaaagcggagtgaaagcgagcacgatgtttgggaaaccgggcacagctcgacttctctgtcaggcgcgatgggaatggcagctgcccgtgatattaaaggaacggatgaatatattattccgatcattggtgacggcgcgctgaccggcggtatggcgctcgaagcccttaaccacatcggcgacgagaaaaaagacatgattgtcatccttaatgataatgaaatgagtattgcgccaaacgtcggtgccattcactctatgctcggacggctccgtactgcggggaaataccagtgggtcaaagatgagcttgaatacttatttaaaaagattccggcagttgggggcaagcttgccgccacggcggaacgagtcaaagacagcctgaaatacatgctcgtctccggaatgtttttcgaggagctcggttttacgtatttgggcccagtggacggacattcttatcatgagctgattgagaatcttcaatacgccaaaaaaacgaaaggccctgttcttctgcatgtcatcacgaaaaaagggaaggggtacaaaccggctgagaccgatacgattgggacatggcatggtaccggaccatataaaattaataccggtgactttgtaaagccgaaagccgcagctccttcgtggagcggtcttgtcagcggaactgtgcagcgaatggcgcgcgaggacggacgcattgtagccattacgccggctatgcctgtcggttcaaagcttgaaggcttcgcaaaggaattccctgaccggatgttcgacgtaggaatcgcagaacagcatgccgcaacgatggcggcagctatggcaatgcagggaatgaagccgtttttggcgatttactcaaccttcctgcaaagggcatatgaccaagttgtccatgacatctgccgccaaaacgccaatgtgtttattggaattgaccgtgcaggactcgttggcgctgatggagagacacatcaaggcgtgtttgatattgcgtttatgcgccacattccaaatatggtcttaatgatgccgaaagacgaaaatgaaggccagcacatggttcatacagcacttagctatgacgaaggcccgatagcgatgcgttttccgcgcggaaacggactcggcgtaaaaatggatgaacagttgaaaacgattccgatcggtacgtgggaggtgctgcgtccggggaacgatgctgtcatcttaacattcggcacaacaatcgaaatggcgattgaagcagccgaagagctgcagaaagaaggcctttccgtgcgcgttgtgaatgcgcgttttattaagccgattgatgaaaagatgatgaagagtatcctaaaagaaggcttgccaattttaacaattgaagaagcggtcttagaaggcggtttcggaagctcgattttagaattcgctcatgatcaaggtgaatatcatactccgatcgacagaatgggtatacctgatcggtttattgaacacggaagcgtaacggcgcttcttgaggaaattggactgacaaaacagcaggtggcaaatcgtattagattactgatgccgccaaagacacacaaaggaattggatcatgacgtcaaagaaagaacgattagatgtattattagtggaaagagggctggcggaaacgcgtgaaaaagccaaaagagccattatggcggggatcgtctactcaaacgaaaaccgcttggacaagcctggagaaaaaattgaccgcgaccttccgttaaccgtcaaaggaaacccgctaaggtatgtgagcaggggcggcttaaagctcgaaaaagcgttgaaagagtttcccgtctctgtcaaagataaaattatgattgatattggctcctccaccggcggttttacggactgcgctttgcaaaatggagctaaacagtcatacgctgtggatgtaggctataatcagcttgcgtggaagcttagacaggatgaacgggtcgtcgtgatggaacggacgaactttcgttatgcaacaccggcagactttacaaagggcatgccggagtttgccacaattgatgtgtcctttatttcacttcggctcatcctgcctgtcctaaggactttgctcgttccgggcagcgactgcatggctctagttaagcctcagtttgaagcgggacgggaatccgtcggcaaaaaagggattgtcagagatcctaaagtgcatgctgatgtgctcaagcgaatgatcagtttttctgccgctgaaggctatatctgtaaaggcttgtcattttctccaatcacgggaggagacggaaatattgagtttctccttcatttgcattggccgggagagggacaggaaggccaggagctgccggaagaagagatcatgcgcgttgtagaagaagcacataagacgttaaaagaaaaaaaagcagatgtaccggaataatagggcgctattattccttttttctgcattcatgtacaatgtgcagagaatcatataacataaaagaacagataagcttggaaatagaggtgcttacatgaacaaaggccagaggcatattaaaatcagagagatcattacaagcaatgaaatcgaaacgcaggatgaattggtcgacatgctgaagcaggatggctacaaagtgacgcaagcgacggtatcacgggatattaaagaacttcaccttgtaaaagtgcctacgaataatggttcttacaaatacagtcttccggcggaccagcgtttcaatccgctgtcaaagctaaagcgggcattgatggacgcatttgtgaaaatagactcagcaagccatatgattgtgctgaaaacgatgccgggcaatgcccaggcaatcggggcgctgatggacaatttggactgggatgaaatgatggggaccatttgcggggatgatacgattttaattatatgccggactcctgaagatacagaaggcgtaaaaaacaggctccttgaactgctgtaacagaaaatctaacaaagataagaggtgtaatgctgtttgttagctgaactatcaattaaaaactttgccattattgaggaactgacggtttcttttgaacgcgggcttacggttttaacaggagaaaccggagccggcaaatccatcatcatagatgccatttctcttttagtcggaggccgcggatcatctgaatttgttagatatggggaagcaaaagccgaacttgaagggctgtttctgttggagagcggccatcctgttttagatgtatgcgctgagcagggaatcgacgtttcagacgaaatgatcgtcatgagacgggatatcagcacgagcgggaaaagcgtttgccgtgtcaatggcaagcttgtcacgattgcttcgctaagagagatcggcaggcttttattagatattcacgggcagcacgataaccagctgttaatggaagacgaaaatcatctccagcttttggacaagtttgccggggccgaagtggaaagcgcgctcaaaacgtatcaggaagggtaccagcggtatgtgaagctgctcaaaaagcttaagcagctttctgaaagcgaacaggaaatggcccatcgtcttgatcttattcaatttcagctcgaagaaatcgaatcggcaaagcttgagcttaacgaagatgaacagctccaagaagagcgccagcaaatttcaaactttgagaagatatatgagtcgctgcaaaatgcatataacgcgcttcgcagtgagcagggcggattggactgggttggaatggcatcagcgcagcttgaagatatatctgatataaacgaaccgctgaaaaaaatgtctgaaagtgtttcgaactcctactatttgcttgaggatgccacatttcagatgagaaatatgctggatgagcttgaatttgatccggaacgcctgaactatattgagacgcgacttaatgaaatcaaacagctgaaacgaaaatacggtgccactgttgaagacattttggaatatgcttctaaaattgaagaagagattgaccaaattgaaaacagggacagccaccttcaaagcttgaaaaaggagcttgactccgtcggcaaagatgtcgcagtggaagcggcaaatgtgtcacaaatccgaaaaacatgggcgaaaaagctggctgatgagattcatcgggaattaaaaagcctgtacatggaaaaatcaacttttgatacggaatttaaggtcagaacagcgtcacgcaatgaagaggcgccgcttgtaaacgggcagcccgttcagctgactgaacaagggattgacctggtgaagtttttaatttcaaccaatacaggcgagccgctgaaatccctttcgaaagtcgcttcaggtggagagctgtcacgggtgatgcttgccataaaaagcattttttcctcacaacaggatgtgacatcgatcatttttgatgaggttgataccggtgtaagcggcagggtcgcacaggcaatcgctgagaagatccataaggtgtcaataggttcacaagtgctgtgcattacacacctgcctcaggtggctgccatggcggatactcatctttatattgcgaaggagttaaaagacggtagaacgacgacacgtgttaagccgctctctaagcaggaaaaggtagcggaaatcgggcgcatgattgcaggtgtcgaggtaaccgatttaacgaaacgccatgcgaaagaacttttaaaacaagctgatcaagtcaaaacaactgggtaagctgcgcgagaagcgcagcttatttttttcgtgcacatccattcgttcatcagtatatccaatgtttttcttcatatgacagttataaataagccgtcagaaggcaaaattaaatgatgtagcagcaagtcataaagaaggtgtgggataggagcgaggagagtgaagtaatgaatgcccgataacatcagaaaagcagtaggtttaattctccttgtttcgttattaagtgtaggtttatgcaaaccgctaaaagaatatttactgattccaacgcaaatgagagtatttgaaacccaaacacaagcgattgaaacgagtttatcggtaaacgctcagccatcagaatcctcagaagcgtttacagtaaagaaagatccgcatgaaatcaaggtgacgggcaaaaaatcaggtgagtcagaattggtatacgatcttgccggatttccaattaaaaaaacaaaagtgcatgttcttcctgatttaaaggttatacctggcggacaatcaatcggtgtaaaacttcattccgtcggtgttcttgtcgtcggatttcatcaaatcaatacaagtgaaggcaaaaaatctccgggagaaacggccggaattgaagcgggcgacatcattattgagatgaatggacagaaaattgaaaaaatgaatgatgtagccccatttattcaaaaggctgggaaaactggtgaatctttagacttactgatcaaacgtgataaacaaaaaatcaaaacgaagctgatcccagaaaaggatgaaggagaaggtaaatacagaatcgggttatatatcagagattctgctgccggcatcggcactatgaccttttatgaaccgaaaacaaaaaaatacggagcacttggccacgtgatttccgatatggacacaaagaaaccaattgtagtggagaatggagaaatcgttaaatccactgtaacatcaatcgaaaaagggacaggcggtaatccgggagaaaaactggcgcgattttcctcagaacgcaaaacgatcggggatattaacagaaacagcccatttgggattttcggcacgctgcatcagccgattcaaaacaatatatcagatcaagcattgccggttgcgttttctaccgaagttaaaaaagggccggctgaaattttaacggttattgatgatgacaaagtagaaaaattcgatattgaaatcgtcagcacaacgccgcaaaaattccctgcgacaaaaggaatggtgttgaaaattaccgatccaaggctgttgaaagaaacaggaggcatcgtacaggggatgagcggaagcccgattattcaaaatggaaaagtgatcggcgctgtcacccatgtattcgtaaatgacccgacaagcggctacggtgttcatattgaatggatgctgtcagaagcaggaatcgatatttacggaaaagaaaaagcaagctgactgccggattttccggcagtttttttattttgatccctcttcacttctcagaatacatacggtaaaatatacaaaagaagatttttcgacaaattcacgtttccttgtttgtcaaatttcatttttagtcgaaaaacagagaaaaacatagaataacaaagatatgccactaatattggtgattatgatttttttagagggtatatagcggttttgtcgaatgtaaacatgtagcaagggtgaatcctgttaactacatttggggaggaagaaacgtggagaaaattaaagtttgtgttgctgatgataatcgagagctggtaagcctgttaagtgaatatatagaaggacaggaagacatggaagtgatcggcgttgcttataacggacaggaatgcctgtcgctgtttaaagaaaaagatcccgatgtgctcgtattagatattataatgccgcatttagacggacttgcggttttagagaggctgagggaatcagatctgaaaaaacagccgaatgtcattatgctgacagcctttgggcaggaagatgtcacgaaaaaggccgtcgatttaggcgcgtcctactttattctcaaaccgtttgatatggaaaaccttgtcggtcatatccgccaggtcagcggaaatgccagcagtgtgacgcatcgtgcgccatcatcgcaaagcagtattatacgcagcagccagcctgaaccaaagaagaaaaatctcgacgcgagcatcacaagcattatccatgaaatcggcgtcccagcccatattaaaggctatctctatctgcgcgaagcaatctcaatggtatacaatgacatcgaattgctcggcagcattacaaaagtcctctatccggacatcgccaaaaaatttaacacaaccgcaagccgtgtagaaagagcgatccgccatgcaattgaagtggcatggagcagaggaaacattgattccatttcctcgttgttcggttatactgtcagcatgacaaaagctaaaccgacaaattcggagttcattgcaatggttgcggataagctgaggttagagcataaggcttcttaaacatgagcttattaagtggtcattaaatcaaacgtcttttatttattagtttgcgctgataaataggaggcgttttgttttggggacatttgttagtatgggagaagaatattaagtatccgcatatagtaaaggatgggtttgaaaagtaaggaaagcaaatggcggtattacctgcactcttggtccattcatacatcttataggatcacgagcatgatcgaccctagatgtgtccgttataaaatgaaacctttctcctgcaaaatcgtaagtaaggcgtattcatgtaaaaaggagacgtacgaatgaaaaagaaaaaagcaagaaagcgtgaggggtttttcctggattttcttttcgaagttggcggggagctctttcttttgctgtttagatgtgtacacaaactatttatataaagggaaaaaagactgccgaatcgtttcggcagtctttgcacattaatctttataaggcacccagcctggcgtgttcacaattgcttgccatagcggttcaggcaaatgatatttttctttatctgtgcctttgatcactgtttcgatttgcttttcacggccttcttttacttttaccgtccagtcagggtcaactagaatttcgcgtcccatagcgaccagcggaataccgttttcgatgacggcaagcgcgtcatcagcggaatggatggaaccgacggcgatcagcggcactttgtttccgacacgttcattcaataagtccatgcgtgtgcgagtcggatctgcaccgcggcgcgcttttgagttcacgtccatcagtgagacatgaagataatccaattctttatctcctaaagcatcaacaagcgtataagtttcagtcattgtcaatcccggtgtctcaggttcttccggagacaggcggtatccgactaagaacgcacccttcgcatgttctgaagcggcttttttcacttcatcgacaatagcgagcgggaaggctaatcgtttttcatcgcttcctccccagcgatccgtgcgctggttggttttcggagaataaaactgctgaattaagtagccgtttgcaccgtgaatttcgacaccgtcaaagccggcttcaatggcgcgtcttgtcgcttctccaaacgccttcacaatgttttccacttcttcttcttttaatgcgcgagcaatttgtttgcctttatcaaacacgtcacttggccccacaacatcctgttgaggaacgagctcagacgggcactcaataccgccgtgatgaatttgtacaacagctttagcgccttgtgcctgaatggcttgtgctaacttttttaaacctggaatgttggaatcgtcatggatggccggctgcccggggaatgcttttccgtccggtgtaacatttgcgcaggctgtaatcaccattcccatctcttttgaacgggggatgatgtagtcgagctccgcttcagatattgtaccgtcttcattagaagcgtaatgagtcatcggtgctactgcgatccggttgtcgattgtaacgccgcttttaaacgtaaatggttcaaaaagtggcttatacttaggattcatttgatcatcttctttcgtttggcttcgcacatattctagcctatatgtaaaaattaatgcaattgatctgctttaccgactgaatatcttgagtgcagagtgatgttttcgccgctctttttcggggcctttgtagccgccgctgatttggtggccgatggagcatgtgatgacagctgccgccagcagcagaacgaattttttcatggctttaacttctttcaataaagtaaatatcctttaaaaggttacgcttggctgacccacccgtcaaacgatttgctcaccctattctcaaattttttaaaatgaataaaaagttgcttctttccgctaattttttctaattggcgcctcaattagagccatcctcatagacaaatctgctcgttatctttctaacaacaggaaatgatcgggtcgtatagcccttttgaaaatcatggaacttgctcgcctgcattcgcgttgtctttacaaattcgccattctggtcaaagataaaagccaaacatcaggaagaggtggtcatgtgaaacaaacggttcttttgctgtttactgcgctctttctttcggggtgcagtgttgcaagtgcggatgactcagtgccaaggtttaccgaagagggaaaatacattggctcggctgatcctcatacgattgcggtttctcttaatggagaagaaaccatgatacaagttccgaaggataaacgtgatgaatgtgaatcactgccagatcagacacatgtcctggtgaaatatacaaagaaggataatggaactttacagctggaagatattcagctgcgaaagaactcgtcataaaaagaccggagggagtaagttgagaatgttatggaggagcttggcgctgtgcggattggctttgacgctcgcgccttgtgcacaggcagcagagccgatagaagggaaaacagtgtatattgatgccggacacggcggtgaagatagtggagcggtcggaaacgggctctttgaaaaggatattaatttggctgtctcagagcatgtgacagacaaactaaaagaggagggagccaatcctgttgtatcccggtctgacgatcattttctgaccttggaggaaagagtggctaaggcaagtgccaatcaggctgacctttttgtcagcattcatgtgaattcaggggttgcttcagcttcaggaacagaaacgtattttcaatctgattatgaaggggagaacagccggcgtctggcatccgatattcagtcagagctcgtttcttccttacaaacgagagacaggggcgtgaaagaatcagacttttatgtcattacatattcacaaatgccaagtgtgttggcggagcttgggtttatcacgaacagctctgacgcggacaagctgggaagtgaagaataccagcaaaaggccgcagatgcgattgtcaacggcattgattcttattatgatcagtagattgatacagccttaatcctagagtggaaccgacaaaataagtataatggagaaaactttagggtttgaggtgaaacgatgacaaagatttttgcccaccggggggcatcaggtcaatttcccgaaaatacaatgcttgcatttgaaaaaggaattgaagccggagcggatgggatagagcttgatgtacagctgacgaaagacggacgcattgttgtaattcatgatgaaagacttaatcgcacgacatcacttaaaggattcgtgaaggatacagcctatgatgaggtaaagactgcgaatgcggccgctggtcacgatcaagcgtacagcgatataaaagtgccgctgctagaagatgtgctctcgtgggcggtaaaaaaggattttctcatcaacattgaattaaaaaacagcgtgatccgctatgagggaatggaagaaaaagtgctggaggcagtgaagcgatttaatgtagaggacagagtcatcctatccacgtttaatcatgacagcttggcgctgtgcgcccggcttgcaccgcatatcgaacgggcagtattaacttcagatgtgctttatcaggcagatcgatatatcgcgtctattccggcttccggctatcacccgaagttaaacagcccaggggtcacagatgaagtactgaagaaaatgaggaacggtttgattaaggtaaggccgtatacagtcaatcgtccggaagatatgaagcgtctcattgaagcgggagcagacggcatgtttaccgactttccagaaaaggcttcggcattgctgaaaaatgaatagttgttagaaggaggctgtttgacgcagccttcttttttcattcattcatgcccgtttcaaagcatacattcatagaagacaactagaaattgtaagcgctgtctatcttctgaatgaggtgaaaccatgaggaaaacagtcattgtaagtgctgcaagaactccatttggcaaattcggcggagttttgaaagaggtgaaagctgctgagcttgggggcattgtgatgaaggaggcgctgcaacaggctggagtctctggagatgatgtagaaggaaacgtcatgggcatggttgtccaggccggctcagggcagataccttcccgtcaagctgcccgtctggcgggaatgccttggagtgtgccctcagaaacactgaataaagtctgtgcttccggccttcgcgctgtcactttatgtgatcaaatgattcgggcgcaggatgcggacatacttgttgcgggggggatggaaagcatgagcaatattccgtatgccgttcccgccgggcgctggggagcacggatgggagacggcgagcttagggacttaatggtgtatgacggattaacgtgcgcatttgacgaggtgcacatggctgttcacggaaatacagctgccaaggaatatgcaatctcacgaagagagcaggacgaatgggcgttgagaagtcatgcaagggcagctaaggccgccgatgaagggaagtttcaggatgaaattgttcccgtcaactggatcggccgaaaaggaaaaccaaacgttgttgataaagatgaagcgattcgccgtgacacaagtctggatcagctcgcgaaacttgctccgatttttgcaagtgacggttctatcacagccggcaatgctcccggggtcaatgacggagccggcgcgttcgtgctgatgtctgaggaaaaagctgctgagcttggcaaacggcctctggctacaattcttggtttttcaactacgggaatgccagcgcacgagctggcggcagcgccggggtttgccattaacaagctcctgaaaaagaacggtttgactgtccaagatattgacttgtttgaagtaaatgaagcttttgcttcagttgttttgacatgtgaaaaaatcgtaggtttcgatcttgaaaaagtaaatgtgaatggcggtgcgatcgcgctcggccacccgatcggcgcgagcggggcgagaattctcatgacgcttgtttatgaattaaagcgccggggagggggtctgggcgttgccgctatttgcagcggggcagcacagggagacgccgtcttagtgcaggttcattaaaacatgatgaaaaaggggatttgaatggaaatcaaacaaatcatggtagctggcgcaggtcagatggggagcggaattgctcaaacagccgccgacgcgggcttttatgtgcggatgtatgatgtgaatccagaggccgcggaggcaggattgaaacggctgaagaaacagctggcccgtgatgctgagaaaggaaaaaggaccgagacggaagtgaagagcgtaatcaaccgcatttcgatttctcaaacgcttgaggaggcagagcatgcggacattgtgattgaggctatcgcagaaaacatggcggcaaaaactgagatgtttaaaacacttgatcgcatttgcccgcctcatacgattttggccagcaatacatcttccttgcctattacagaaatcgctgctgtaacaaaccggcctcaacgggttattggcatgcattttatgaatcccgtccctgtaatgaagctggtagaagtgattcgaggcttggctacatcagaagaaacggccttagatgttatggcattagcggaaaagatggggaaaacagcggtagaagtcaatgattttcctgggtttgtttccaaccgtgtgcttcttccaatgattaatgaagccatctattgcgtgtatgagggagtggcgaagccggaggcaatagatgaagtgatgaagctgggcatgaatcatccgatgggtccgcttgcattagcggattttatcggactggatacgtgtttatcaattatggaagtccttcactcaggccttggcgattccaaataccgtccatgcccgctgctccgcaagtatgtcaaagcaggctggcttggcaaaaagagcggacgcggtttttatgactatgaggagaggacttcctgaagtctattccatccgggggtggccgagttgcatgtaacccaagagcaagtcatgatgcgaaaaatggtgcgtgattttgcacgaaaagaaattgctcccgctgcggaaatcatggagaaaacggacgaatttccctttcagctgatcaaaaaaatgggcgaacatggcctgatgggaataccagtgccggaacagtacggcggtgtcggggcagacgttgtttcttatattttggcgattcatgagatttctagaatcagcgcggctgtcggcgtgattctctccgttcatacctcagtcggcacgaatccgattctgtatttcggcaacgaagagcagaagatgaaatatataccaaagctcgcgtcaggagaccatttgggcgcatttgcactaacggagcctcactcggggtcggatgccgggagcctccgcacaacagcaatcaaaaagaacggcaaatatctattaaacggatcgaaaatattcataacgaatggcggagcagctgatatctatatcacatttgctttaacagctccagatcaaggcaggcacgggatttcggcttttatagttgaaaaaaacacacccggttttaccgttggaaaaaaagaaagaaagctggggctttatggctccaatactacggaactgatttttgataatgcagaagtgcctgaagccaatttgcttggcaaagagggggatggctttcacattgccatggcgaatttaaatgtcggccggatcggcattgcggcacaggccctcggaattgcagaggcggctcttgagcatgccgttgattatgcgaagcagcgagtgcaatttggaaggccgatcgcagccaatcaagccatttcatttaagctggctgatatggcgactagagctgaggcggcaagacatcttgtctaccacgctgcagaccttcataaccgcggcctaaactgtggaaaagaagcgtctatggctaaacaatttgcttccgatgcagccgtgaaggcagcgttagacgccgttcaaatttatgggggatatggctatatgaaggattatccagttgagcgcctgcttcgcgatgcaaaggtgacgcaaatttatgaagggacgaacgagattcaaagactgattatttccaagtatttgcttggcggaacctgatagacaaaaaacgcaaaaacggaggttgaggatatggaggagaaacagcattattctccagggttggacggtgtgattgcggcagaaactcatatttcttatcttgacacgcagtccagccagattttgataagaggctatgatttaatagaactttctgaaacaaaaagctatctggagcttgtccatttattgctggagggcaggctgccagaagaaagtgaaatggaaacgctggaacgtaaaataaacagtgcctcaagcctgcctgctgatcatctccgtctgcttgagctgctccctaaggacactcatccaatggatggtctgcgtaccggcctgtcggcacttgctggctatgatcggcaaattgatgatcggtctccttccgcaaacaaagaacgcgcctatcagcttcttgggaaaatgcctgccctcactgctgccagctacaggatcattaataagaaagaaccgattcttccgcttcaaaccctatcctacagtgcgaattttctctacatgatgacagggaaattgccgtcttcattggaagaacagatttttgaccggtcgctcgtcctgtacagtgagcatgagatgccgaattcaacctttgcggccagggtcattgcatctacacattcagatctttatggggctttgactggggctgtcgcttccctgaaagggaatcttcacggaggagcaaacgaagctgtgatgtatttgcttttggaggcaaaaacgacatctgattttgagcagcttttgcaaacaaaactgaaaagaaaagaaaaaatcatgggcttcggccaccgggtgtatatgaaaaaaatggacccgagagcactcatgatgaaagaggcgctgcagcaattatgcgataaagccggtgaccatcgtttatatgagatgtgcgaagcgggtgagcggctgatggagaaggaaaaagggctttacccgaatttggattactatgctgccccagtgtattggatgctcggcataccgattcctttatatacgccgatctttttcagcgcgagaacgtccggtttatgcgcccatgtgatcgaacagcataccaataatcggctcttccgtccccgtgtcagttacatgggcccgcgatatcaaacaaaaccatgaaaggaactggtagaatgccgaaaacggatcgtgttatcgaagaaatcacagactatgtgcttgagaaagagattactagtgccgaagcgtatacaacagcggggcatgtattgctggataccctgggctgcgggatcttggcgctacggtatccggaatgcgcaaagctgcttggcccgattgttccaggaacgactgtgccgaatggaagcaaagtgccgggaacgtcatatgttctcgatcctgtgagggcagcgtttaatatcggctgcatgattcgctggctcgattacaacgatacgtggctggcggcggagtgggggcatccatccgataacttgggaggaatccttgccgctgctgattatgtatcaagagtgaggctgtctgaaggaaaagagccgttaacagtacgcgacgtacttgagatgatgatcaaagcacacgagatccaaggtgtgctggcgttagaaaacagcttaaatcgagttggccttgaccatgtgctgtttgtcaaagttgcgacaaccgctgttgcggcaaagcttttgggcggcggaagagaagaaatcaaaaatgcgctttcgaatgcatggattgacaatgcagcattgaggacataccgccattcaccaaatacaggctcgcgtaaatcatgggcggcaggagatgcaacgagcagaggtgttcatttggcgctgatgtcgttaaaaggggaaatgggttatccgacagccttgagtgcaccgggttgggggttccaagacgttttattcaataagaaagagatcaagcttgcccgtccgctcgacgcttatgtcatggaaaatgtgttatttaaagtgtcttatcctgcggaatttcacgcccagacagcggcggagtgcgccgtcattcttcacccgcaggtaaagaaccggattgatgagattgaccgagttgtcatcagaacgcatgaatccgctatccgaatcattgataaaaaaggcccgctccacaatccggcagaccgtgatcactgcctccaatacattacagcaatcggtttgctttttggtgatatcaccgcacagcattatgaagctgaaacagcgagtgatccgagaatagataaacttcgtgataaaatggaagtgactgaaaataaaacatataccgaggattatttgaaacctgataaacgttccatctcaaatgccgttcaggttcattttaaagacggaacgagcacggaaatggtggaatgtgagtttcccctcggccatcgttttcgaagagaggaagcagtgccgaaactgctggaaaagttttctgacaatctcaaaacccattttcctgataaacagcacaaacacatttatgagcgctgtaccagctatgagacattacaaacgatgcgcgtaaatgaattcgtagacatgttctgcatgtaaaagggggatttgtttcatgtcgtggatcgtcaataagcaatcgtcacaagaggagcttgccgggcgtttccgcaagctgatgtcagcaccggacattcttcaaattcccggcgcccatgacgggatggccgctttgcttgcgaaagaagccggtttttctgctatttatttgtccggtgctgcctatacagccagcagggggctgcctgatttagggatcatcacatcggcagagatagctgaacgggccaaagatcttgtacgtgcagctgatctgcctctgcttgtggatatcgatacgggatttggcggtgtcttaaatgccgcccgaacagcccgggagatgcttgaagcaagggtagcagccgttcaaatagaagaccagcagcttccaaaaaaatgcggacatttaaatggcaaacagctagttccgataaaggaaatggcgcaaaaaataaaagccattaaacaagcggcaccctcccttattgttgttgcccgtactgatgccagggcgcaggaagggcttgctgccgcaataaaacgttcagaggcttacattgaggcgggagcggacgcaattttcccggaagcgctacaggcggagaatgaattccgccagtttgctgagcgtatccccgttccgctccttgtgaatatgactgaatttgggaaaacgccatattatcgtgccgatgaattcgaagatatggggtttcacatggtgatatatcctgtcacctcgcttcgagcggcggcaaaagcttgtgagcggatgtttggtttgatgaaggagcacggctcacaaaaagaaggacttcatgatatgcagacacgaaaagaactgtacgatacgatttcttattatgactatgaagcgttagacaaaacgattgccaagaccgttttgcctgacgaataatgcaacaaaaaaagccggagcattctccggctttttttcagctatcgttttctgaatcgcgggctgacttgattgcgttttctgtctctgtataaaatgaacccggccagcacatagaggccgatcgcaaaaaagatgaatcctgacaacccttggagccaaagagctgaaaatggcttgattgtatgaccgaaaagtgtatctctcatcagtttaatgcctaaagcagaaatagccccggggatgactaatattaaaagcgcaagaagtcggctcatcttcagaaaacccctttatcttttcatttcctttattgtccagcggaaaaaatattttgtcaagagaagaaaacgtggtaacatagggttgtgcaaattattgcaacggaataaataggtatgcaaattttttcatacaaaggggtatcgggatgcaaaaggtactgatagtaggtgccggcaaaaggggaacggcgttattacatattctgattaaaacagccatcatagatatcattgccgtagttgacaaagaccccgaggcgccgggattgaaagaagcagaacagtatgggattgccgtttcatctgattggaaaccttacatacaacaaaaaccggatatcgtcattcatactaccggcgatcaagccgtgtttgacgagctccttcaaagaaagcatgaagataccattgtcatgccgggaaaaatggcatacatcgtttttcagctgatggaagaaaagcagcacctgattcaaatgctaaaagagcaaacctataaatatgacagaatttttaattccacccatgatggaatgatttttattgatatcaatgaagaaatcattctctttaaccatatggccgaaaaaatggtcgggaaaaaacgtgaggaagtcattgggcgcccaataaaagaagtgattccgagcactaagatgccgcggattttaaaaacaagagtgcctgaatacaaccagaagcagctgttaggcgatcatttgcaaattgtgaccacaaggctgccgattattgatgaaggcggacgtctgctcggggctctttgtgtgtttaaagatatcactgatgcggtcgagctggcagaggaagtgaccaacttaaagcaggtccgtacgatgctggaggcaattattcaatcctccgatgaggcgatttctgtcgttgatgaaaacggcatcggcctgctaatcaataaagcgtatacgaaaatgacggggctttctgaaaaagaagtcatcggcaagcctgcaaacactgatatttccgaaggcgaaagcatgcatttaaaggtgcttgaaacaagacgtcctgtccgcggtgtcagaatgaaggtcggcccgaatgaaaaagaggtcatcgttaatgtagcaccggtgattgtggacgggattttgaaaggcagcgtcggcgtgattcacgatgtttccgaaattaaaatgctgacagcggagcttaatcgcgccagacaaattattcgcacgcttgaagcgaaatacacgtttgacgacattatcggcaaaagcgagcaaatgctggttgcgcttgagcaggcgaagctcggtgcgaaaacaccggcaaccatcttgctgcgcggggaatcaggaacaggaaaagaactgttcgcccatgccatccataacgaaagtgaccggaaatacaataaatttattcgcgtgaattgtgcagccctttctgaaaacctgctcgaatcagaattgttcggctatgaggatggcgcgttttcaggagcgaagcgcggcggtaaaaagggtttatttgaggaagcaaataacggcagtattttcttagatgaaatcggtgagctgacacaaaatatgcaggccaaattgctacgcgtccttcaagaaaaggaaatcgtcagagtgggcggcacgaaagcgatccctgtcaatgtcagagtgatcgcggcgacaaatgtaaatattgaaaaggcgatggcggacggaacattccgggaagacctgtattaccggatcaaccgctatccgatctccatcccgcctttgcggcagcggttggaggacattgaagcattgagcgtcagacttatccaaaagatcaaccgggattacggcaggaatgtaaaagggctctcacagcaagccttgcgcgccttatctgcctaccattggcctgggaatgtccgggagcttgaaaatgtccttggacgagccatgatttttctgaatccgcatatggaatggattgaaaaagatcacttgcctgtattcgaacttgagcaaaaagaaaatgacacagaccagggaacaggttttgattttccggatattgaaggcgaaaagctgtctgtcgcagtagaaaaatttgaagcacatttgatccagcaaacgcttgaaaagcatcattttaaccggacaaaaacagcaaaagctctcggtgtcagcattcggaacttatattacaaaatggataaatatggccttgcaaatgaaggcatgcaataatttgcagaataaacgcaaacatctgcacgaatgtttcaatatacctggtatgacagcacccttaagagctggcatggaacttgcataataaaaggcggagtcgaaacaagaaaggtggtaacagatgaagctgaaagatttaatcggcaaagcgtcgatacacaaaaataagaccattgcggttgctcatgctgaggatgaggaagtgatccgggctgtaaagctggcagccgagcacctatccgcccgtttcttgttaacgggcgacagcacaaaactgaacgagctgacatcatccatgcaagggcatcaagtggaaatcgtccatgccgatactcctgaggaatcggcgaatttagcggttcgtgctgtgcatcataaaacagcggacgttttaatgaaaggcaatgtgccgacttctgttttgcttaaagcggtattgaacagacaggaggggcttcggtcagcaagtgtcctttcccacgtggctgtcttcgatataccggattttgaccggctgatgtttgtgacagattcggcaatgaatattgctccttcgctggaagagctccggcagattttgcaaaatgccgttcatgtggcccatgcagtggggaacaatatgccaaaagcagctgcccttgcagcggtcgaaacggtgaaccctaagatggaagcgaccgtgaatgcagctgctctagctcaaatgtacaaaaggggccagatcaaaggctgcattgttgatggaccgcttgctttggataacgcagtttctcaaattgccgcggcccagaaaaaaatttcgggagacgtagcgggcaacgcagatatccttctcgtcccaacaattgaggccggcaatattttatacaaatctctgatttattttgccaaggccagcgtggcggctgtcattacaggagccaaagcaccgattgccttaacaagcagagcggactctgctgaaaataaactgtattccattgcgctggcaatatgcgcatctgaagaatacacacattaggaggaacgaacatggaactttttaaatatatggagaaatacgattacgaacaattggtattctgccaggatgaacaatctggattaaaagcgattatcgcgattcatgatacaacgcttggtccggcgcttggcggaacgagaatgtggacatatgaaaatgaagaagcggcaattgaagatgcgctcagattggctagaggcatgacctataagaacgcggcggcaggcttaaaccttggcggcggaaaaacagtcattatcggcgatccgcgcaaagacaaaaatgaagaaatgttccgcgcgtttggccgctatattcaagggctgaatggcagatacatcacggctgaagatgtgggtacaacggtcgaggatatggatatcattcatgatgagacagactatgtcacagggatttctcctgctttcggctcttctggaaatccgtccccagtcacagcgtacggggtgtacagaggaatgaaggcagcagctaaagctgctttcggaaccgactctcttgaaggaaaaaccattgctgtacagggtgttgggaacgtagcctataacctttgccgccacctgcatgaagaaggagcaaacttaatcgttacggatatcaacaaacaatctgtacagcgtgcagttgaagattttggcgcccgggcggtagatcctgatgatatttattcacaagactgcgatatttatgcgccatgtgcccttggtgcgactattaacgacgacaccattaaacagctgaaggcgaaagtgatcgcaggtgcggctaacaaccaattaaaagagacacgccatggtgatcaaattcacgaaatgggcatcgtttatgcaccggattacgtgattaacgcgggcggtgtcatcaacgtggcagatgagctttacggctataatgcagaacgtgcattgaaaaaagttgaaggcatttacggcaatatcgagcgtgtacttgagatttctcagcgtgacggcattcctgcatatttagcggctgaccgcttggcagaggaacggattgaacgcatgcgccgctcaagaagccagtttttgcaaaacggccacagtgtattaagcagacgttaagaaattgatctggaggttatgaaagtgctacatgacgaaaaacgcattctcacaattaatccaggctcaacttcaacgaaaatcggtgtttttcataatgaaagaagcatttttgaaaaaacattgagacacaacatagaagagctgcagcgatttgaccgaattattgatcagtatgaatttcgtaaaaaccatattctcgaaacgcttcatgaacagggaatcaatatctcgaagtttgatgcagtctgcgcaagaggcggccttctccggccaattgaaggcgggacctacgtagtgaatgatgacatgattgaggacttgaaaagcggttacgccggtcagcatgcttctaatctcggcggcattatcgcgcgggaaatcgctgacggcctgaatatcccttcgtatatcgtcgaccctgttgtcgtagacgaaatgtcagtgcttgcgaaagtttcaggcatgcctgaaattgaacggaaaagcattttccatgcgttaaaccaaaaagctgtcgctcgtaaagcggcagcctctcttggcaaacgatatgagaacatgaaaatgattattacccatatgggcggaggtattacaattggcgttcatgaccgcgggcgagtggtagatgtcaataacggcctgcacggcgagggaccattcagtcctgaacgagcaggaacagtgcctgcgggagatcttgttgatctatgtttttcaggggaatatacaaaagaagaaatcatgaaaaagcttgttggcaccggcggacttttaggctatctcggtacaaatgatgcagtaaaagtggaacagatgattcaggggggcgatgaaaaagcccgcttcatttatgatgccatggcatatcaggtagcaaaggaaatcggggcagccagcgcggcgttaaaaggcgaagttgaagcgattgtgctgacgggaggccttgcgtacggcaaaagctttgtttctgctatcagatcatacatagattggatttcagacgttttagtctatccgggtgaaaatgaactgcagtctcttgcccaaggggcgctcagagtattgcagggcgaagagcaatccaaacaatatcgtattgaatagacagacaggagtgagtcaccatggcaactgagtatgacgtagtcattctgggcggcggtaccggcggttatgttgcggccattagagccgctcagctcggcttaaaaacagccgttgtggaaaaggaaaaactcggaggaacatgtctgcataaaggctgtatcccgagtaaagcgctgcttagaagcgcagaggtataccggacagctcgtgaagccgatcaattcggggtggaaacggctggcgtgtccctcaactttgaaaaagtgcagcagcgtaagcaatccgttgttgataagcttgcagcgggtgtaaatcatttaatgaaaaaaggaaaaattgacgtgtacaccggatatggacgtatccttggaccgtcaatcttctctccgctgccgggaacaatttctgttgagcggggaaatggcgaagaaaatgacatgctgataccgaaacaagtgatcattgcaacaggatcaagaccgagaatgcttccgggccttgaagcggacggtaagtctgtactgacttcagatgaggcgctccaaatggaggagctgccacaatcaatcatcatcgtcggcggaggggttatcggtatcgaatgggcgtctatgctccatgattttggcgttaaggtaacagttattgaatacgcggatcgcatattgccgactgaagatccagagatttcaaaagaaatggaaagtcttcttaagaaaaaaggcatccagttcataacaggggcaaaagtgctgcctgacacaatgacaaaaacatcagatgatatcagcatacaagcggaaaaagacggagaaaccgttacctactctgctgagaaaatgcttgtttccatcggcagacaggcaaatatcgaaggcatcggcctagagaacaccgatattgttactgaaaatggcatgatttcagtcaatgaaagctgccaaacgaaggaatctcatatttatgcaatcggagacgtaatcggtggcctgcagttagctcacgttgcttcacatgagggaattattgctgttgagcattttgcaggtctcgatacgcatccgcttgatccgacgcttgtgccgaagtgcatttactcaagccctgaagctgccagtgtcggcttaaccgaagacgaagcaaaggcgaacgggcataatgtcaaaatcggcaagttcccatttatggcgattggaaaagcgcttgtatacggtgaaagcgacggttttgtcaaaatcgtggcggaccgagatacagatgatattctcggcgttcatatgatcggcccgcatgtcaccgacatgatttctgaagcgggtcttgccaaagtgctggacgcaacgccgtgggaggtagggcaaacgattcacccgcatccaacgctttctgaagcaattggagaagcagcgcttgccgcagatggcaaagccattcatttttaaaagcataaaggaggggcttgaatgagtacaaaccgacatcaagcactagggctgactgatcaggaagccgttgatatgtatagaaccatgctgttagcaagaaaaatcgatgaaagaatgtggctgttaaaccgttctggtaaaattccatttgtaatctcttgtcaaggacaggaagcagcacaggtaggagcggctttcgcacttgaccgtgaaatggattatgtattgccgtactacagagacatgggtgtcgtgctcgcgtttggcatgacagcaaaggacttaatgatgtccgggtttgcaaaagcagcagatccgaactcaggaggccgccagatgccgggacatttcggacaaaagaaaaaccgcattgtgacgggatcatctccggttacaacgcaagtgccgcacgcagtcggtattgcgcttgcgggacgtatggagaaaaaggatatcgcagcctttgttacatttggggaagggtcttcaaaccaaggcgatttccatgaaggggcgaactttgccgctgtccataagctgccggttattttcatgtgtgaaaacaacaaatacgcaatctcagtgccttacgataagcaagtcgcatgtgagaacatttccgaccgtgccgtaggctatgggatgcctggcgtaactgtgaatggaaatgatccgctggaagtttatcaagcggttaaagaagcacgcgaaagggcacgcagaggagaaggcccgacattaattgaaacgatttcttaccgccttacaccacattccagtgatgacgatgacagcagctacagagggcgtgaagaagtagaggaagcgaaaaaaagtgatcccctgcttacttatcaagcttacttaaaggaaacaggcctgctgtccgatgagatagaacaaaccatgctggatgaaattatggcaatcgtaaatgaagcgacggatgaagcggagaacgccccttatgcagctcctgagtcagcgcttgattatgtgtatgcgaagtagggaggaagaacaaatgtcagtaatgtcatatattgatgcaatcaatttggcgatgaaagaagaaatggaacgagattctcgcgtcttcgtccttggggaagatgtaggaagaaaaggcggtgtgtttaaagcgacagccggactctatgaacaatttggggaagagcgcgttatggatacgccgcttgctgaatctgcgatcgcaggagtcggtatcggagcggcaatgtacggaatgagaccgattgctgaaatgcagtttgctgatttcattatgccggcagtcaaccaaattatttctgaagcagctaaaattcgctaccgcagcaacaatgactggagttgtccgattgtcgtcagagcgccatacggcggaggcgtgcacggagccttgtatcattctcaatcagtcgaagcaattttcgccaaccagcccggactgaaaattgtcatgccatcaacaccatatgacgcgaaagggctcttaaaagccgcagttcgtgacgaagaccccgtgctgttttttgagcacaagcgggcgtaccgtctgataaagggagaggttccggctgatgattatgtcctgccaatcggcaaggctgacgtaaaacgggaaggcgacgacattacggtgatcacatacggtctgtgtgtccacttcgccttacaagctgcagaacgtctcgaaaaagatggcatttcagcgcatgtggtggatttaagaacagtttacccgcttgataaagaagccatcatcgaagctgcgtccaaaactggaaaggttcttttggtcacagaagatacaaaagaaggcagcatcatgagcgaagtagccgcaattatatccgagcattgtctgttcgacttagacgcgccgatcaaacggcttgcaggtcctgatattccggctatgccttatgcgccgacaatggaaaaatactttatggtcaaccctgataaagtggaagcggcgatgagagaattagcggagttttaaagacgtaagggaggatacaatcatggcaattgaacaaatgacgatgccgcagcttggagaaagcgtaacagaggggacgatcagcaaatggcttgtcgcccccggtgataaagtgaacaaatacgatccgatcgcggaagtcatgacagataaggtaaatgcagaggttccgtcttcttttactggtacgataacagagcttgtgggagaagaaggccaaaccctgcaagtcggagaagtgatttgcaaaattgaaacagaaggcgcgaatccggctgaacaaaaacaagaacagccagctgcttcaaaagccgctgagacgcctgctgcaaaaagtgccgaagcagctgatcagcccaataaaaagcgctactcgccagctgtactccgtttggccggagagcacagcattgatcttgaacaagtaacaggaacaggtgccggcggccgcattacgcgaaaagatattcagcgcttaattgaaacaggcggcgtacaagaacagaaggctgaggagccgaaaacagcagctcctgcaccgaagtctgcatcaaaacctgagccaaaagaagagacgtcatatcctgcgtctgcagccggtgataaagaaatccctgtcacaggtgtaagaaaagcaattgcttccaatatgaagcgaagcaaaacagaaattccgcatgcttggacgatgatggaagtcgacgtcacaaatatggttgcatatcgcaacagtataaaagattcctttaagaagacagagggctttaatttaacgttcttcgccttttttgtaaaagcggtcgctcaggcgttaaaagaattcccgcaaatgaatagcatgtgggcgggcgacaaaattattcagaaaaaggatatcaatatttcaattgcagttgccacagaggattctttatttgttccggtgattaaaaacgctgatgaaaaaacaattaaaggcattgcgaaagaaattaccggtcttgccaaaaaagtaagagacggaaaactctcagcagatgacatgcagggaggcacgtttaccgtcaacaacacaggttcgttcgggtctgttcagtcgatgggcattatcaactaccctcaggctgcgattcttcaagtagaatccatcgtcaaacgcccggttgtcatggacaatggcatgattgctgtcagagacatggttaatctgtgtctgtccttagatcacagagtgcttgacggtctcgtgtgcggacgattcctgggacgagtgaaacaaattttagaatcgattgacgagaagacatctgtttactaaataagaaaaaagagcattttttgaagttttgtttcaaaaaatgctctttttctattattcagcgattcgtattttcatttcgacacgatattcttcttgttttttcggggagtaatgaatcggtatgattaactcgtatacatcactgactactgttaattggcggtccgcgatataattgataagcttctgtaagttgagaaaataatgttcaggcgaaaaattatacgcgatacacgcatacctccctttagggatcgttgtgatttccatatccggcgtaattgatgaaatttgtttattcgtcaatacaggcgtgaaaatatgacggtaagtcatttcatcaatgctggtgtagggctgaaaagagaaagtagcgccgtagctattgttcgtaaatccatctgctgactcgataaatttttttaatttgctgtaggaggcattgagcacgttttcaggctcgattccttctgcctctgtctgaatgatccgtatttcttcttcatctaaaacaaacaccttaccgagcgcgggatattccatctgccgtttcatccgctttttcaccaatgaaatggtttgctccagggctgataaaaagtctaatttctccctgatttgcctctcctgctctgtataaaaagcaaacagttcttccatctctaagtcctgtgcttttttcatctcttctaaaggtgtgccgatatatttcaatgatttgatcaaatccagatgaatgagctgagaatctgtataatagcggtagctggtatccgggtcgacgtaggcgggtttaaataaatcaattttatcgtaataacggagcgctttaatcgacacgtttgccagttttgaaacttccccaattgagtaatatgattccttcatgccatcactccttctgtcatcagtataaagaagaagcgcattctttgcagtacacaaagaatacgcttcttatcacgtgctggctttaagatgtgcaggcgctttccaagcaatggtcagtgcaatccctatggctaaggtgaccgttgcaaagtagaagggatagtttacatcaatatcgaacagcattccgccgataataggcccgaatacattgccgatacttgtaaacattgaattcataccgccggcaaacccctgttcatttcccgcaatctttgacaggtaagtcgttaccgcaggccgcatgagatcaaatccgacaaatacggtgactgtcaccagcagaatcgcaacatatgaatgtaccgttgtcagcaagaataccagactcgtagagagaattaagctgtaccgaattaaatggatttcaccaaaccatcttgtgaagcggtcgaataagacgacttgcgtaatggcgccaacaatcgctcctcctgtaatcataatggcaatgtcgctggccgtaaatccgaatttatgatccacgaataatgcaaataaagattcaaatgatgctaaaccaaaagacgaaattaagataatgagaaaagctatgaaatacatgggggcaaaaattcgtttaaagcctgtcttctgcccttttatttcctgattttcagggtttcgttccggctcgcgcagcgtgaggattgataaaatggctgctaacagtgcaaaagctgccgcaaagaaaaaaggcagccgggaatggacttctgctaaaaatcccccgatgccggggccgataataaatcctgttgaaatagcggctgacatataaccgagtgctttcggccgtgttttaatggtcgtgatatctgcgataaaagccgtgaccccgggcataatgaaggcagcgctgataccgcccagcatacgggagataaataacatctcaactgtttttccaatgccgaataaaaactccgacacactaaagaacaataggccgatcacgatcatgatcttgcgcccgaagcgatcaacccatcgtccggctattggtgagacaatgagctgtgtaatagcgaagcaggcaaccatatagccgaccgcggtccctgataaatgcaattcattcataatggtcggcgttactggaatcacaagcccgatccccaaaaaagcaataaataaattggttaataatatcgttaaggtaatatttttcttctccatatgacttcccctttttcaagtgtgtatcccttatactgtaagacctcctcctaggggagagtcaacggatttgcaaaatctttctaaagccttatgacagttattcatttgcgggaacaagcatgtcgatatgctgcggcaggacctgaatgactgcgggtgtatgtgtataaacttctccatccatatccgcctttttggcagtgtctgtttcaatctcgatacgggaggcctggacataggacagctctccggtaaaacgatcaattgagccctgttccatgctcatcagctcccgcagcgcggtgaggttggtgttgcggcatatgagaacatcaagtaagccgtcttcaatactggcatcgggcagaggaattcgattcgttccaatgtattggccattcatcacaagcagcataacggcttcttctttaatttcttctccatcaatttttaatgtcatcggaaacgatgcagcggatgagacggttcgcaaggcacttgtaaaatagctgatttttcccaataatgctttttccgtttcgttgatttgattcgacgtttctgcaattaagccgatcccccagaaattcaaaaaataacggtcattcatctgacatacgtctacgctggttttttttcctgccataagtgcttccgcggcctttgcaagattttgagggatgccaagcactcttgaaaagtcattgcacgtgccgccgggcaaaattccgacagcgggttttctttctagagcgctgatagcatttatgcattgatggatcgtgccgtcgccgccgagaatgaagacggtgtcgacagaatcatcaatggattggcaaaaatgatacgcatcatcctttttctttgtctgcttaataatcacctcatctaaatggtgagataaaaccggcaccacagcaccaagtgctttttctatatttttgttaccggcatttccgttatgaatcagtaacgctttcctgtggctcatatacaactgctcctttattttacttctagttatataatcccctttttctgtaagcagtaaacgaagagcaaaaaaagtgcacggcgaagcaaagtcatttgccgatatggacgtttccttgctatcataagaacagatgatgaaaaaggagaggtcttcattgaacatggactttaatttatttatgaatgatattgttcgccaagcgagacaagaaataacagctgccggatacaccgagcttaaaacagccgaagaggtggatgaggcacttacgaaaaaaggaacgacgctcgtcatggtaaactctgtttgcggatgcgccggaggaattgcaagaccggcagcctaccattccgttcactatgataaaagacctgatcagctcgtcaccgtttttgccggacaggataaagaagcgacagcgcgtgcgcgtgactattttgaaggttatccgccatcttctccgtcctttgcgattttgaaagacggaaagatcatgaaaatggtagagcgccatgaaattgaaggccatgagccgatggctgtagtggcaaagctgcaggaagcctttgaagaatattgtgaagaagtataagacgaacaacccggatgctcaaagcagcccgggtttttttgtgcataaatttccaaggatatatgaataaatattaagggattattcaatcggattgtacagcgatttaatttttatctagtaatatcagaagacatcactggaaagataagcttaaagataatttttaaaaatagtattgcataaaaatgagaaactgtttaaaatacaaattaacgaataaatattcaaatacaccaaaagtaatgaatacgggggaaatggatcatgaaaaaatggctcttattacttgtagctgcttgcatcacctttgcattaactgcgtgcggctcaagcaattcaggttcagaaagcggaaagaaaaaattaattatgggtacttcggcggattacaaaccgtttgaatataaagaaggagataatattgtcggctttgatgtagagctggcaaaagctctggcaaagaaggcaggctatgaaattgaagtgcaggatatggacttcaacagcttaattacagcgcttaaatcaaaacaggtggatctcgttctgtcaggaatgacaccaacgcctgagcgtaaaaaacaagttgatttttccgatgtgtattacacagcgaaccatatgattgtcagcaaaaaagacagcggcattcaatctttgaaagacctgaaaggaaaaacagttggcgttcagcttggctctattcaggaagagaaggggaaagagctttatccagaatatggttttaaaacagaagaccgcaacagaatttctgatttggtgcaggaaatcaaatctgaccgcttcgatgccgcgattattgaagacattgttgcagaagggtatttcaaatcaaatgatgacctgcaaggctttgtgattcctgatgcgaaagcggaagaagccggttcagcaattgctttcagaaaggacagtgaactgacagacaaattcaataaagcgctcaaggaaatggaagataacggagatcttgagaaattgaagaaaaaatggttcactggcgagaagtaaaaaagcggctcaactttttcgttgagcttttttattgaataggaaacttttttcctgtaagaaaaggagacaaaggctatgaatttggatttttcagcaacgatcccccaaattccttttatattagaaggcttggcaattacattaaaaattgttgttgtatctgctattatcggacttatactcggtattgtgctaagcttatgcaagatcagcacattccgcccgtttatctggatcgctgatttttatacatcagtgttccgaggcacgcctttagtgctgcagcttatgattgtctattttggccttcctcagctgctcggatttcaaattgaccagttttgggctgcggttgtcgcattgtctttgaattccgccgcttatgtatcggaaattatcagagccggaatcaatgccattgataaagggcaaaaagaagctgctgttgcactcggtgtcccgtatggaaaaatgatgaaggatctgctgctgccgcaggccttcaaaaatatatcacctgcaattgtgaatgaattaattacgttaacaaaagaatcggcgatcgtcaccgtcatcgggcttggtgatgtcatgagacgcgcatatcaagctggcgccgccacttacaattaccttgagccgctcattatcgcgggattgatttattatgtgcttgtcctgattttaacgtttatcggcaaggctgtagaaaggaagctgaaatccaatgattaaggttgaaaagctgtcaaaatcatttgggaaacacgaagtattaaaaaacatttcaacaacaatcgctgagggtgaggttgttgccgtgatcggtccttcaggctcaggcaaatcaacgttcttacgctgtttaaacctgttggaaaagcctaacggcggaaccattacaataaaagacacagagattacgaagccgaaaaccaacacattaaaggtccgggaaaacatcgggatggtttttcagcattttcatctctttccgcacaaaacggttctcgaaaacatcatgtacgcgcctgtcaatgtaaaaaaagaatcaaaacaggctgcacaggagaaagctgaggacctgctccgcaaagtcggtttgtttgaaaagcgaaatgactatccaaaccgtttgtctggcggacaaaaacagcgtgtcgcgattgccagggctcttgcgatgaatccggacatcatgctgtttgacgagccgacctccgcccttgatccagagatggttaaagaagtgctacaggtgatgaaagagctggtcgaaaccggcatgaccatggtgattgtcacacatgaaatgggcttcgcaaaagaagtggcagaccgtgtgctgtttatggaccaaggaatgattgtcgaagacggcaatccgaaggaattttttatgtcgccaaaatccaaaagagcgcaggactttttagagaaaatattatagaatataaaaaagaagaaggctggccgcctcttcttttttattgaagaaacacatagaaatggagtccgacatgtttaaaattggttatcgcacaataaagaccgcgcttggaacagctttggctatttatataagccagttattgcatttgcaaaacttcgcatcagcagggatcatcaccattttgtgcatacaaatcacacaaaaacggtcgcttcaggcctcatgggcccgctttgcggcatgctgtctggcaattgttttttcttttctctttttcgagcttattggctaccacccgtttgtgatcggagcgcttcttttgatattcattccgataacggttctgttaaaaattaacgagggtatcgtcaccagttccgttattatccttcatttatacatgtccggcggcattacgcttgctttcatctggaatgaagttcagctgattacggttggcatcggcgtcgctctattgatgaacttgtatatgcctagtcttgaccggaaactgattgcctaccgcaaaaagatagaggataactttgctgtcatttttgcagaaatcgaacggtatttgttaactggtgagcaagattggtcaggaaaagaaattccggaaacgcaccagctcattacggaggctaaaaacctggcatatcgagatgtgcaaaaccacattttgcgttacgaaaatctgcattatcattattttaaaatgagagaaaagcaatttgaaattatcgaacgccttctccctaaagtgacatcgatctccatcacggtagatcagggaaaaatgatcgctgaatttattcatgatttgcgggaggcgatacaccctgggaatacagcgtacaaatttctgaaaagacttgctgacatgagaaaagaatttgaggagatgccgcttccggcgactagagaggaatttgaagcgagggccgctctcttccatcttctcggcgaaatggaacaatatttagtgattaaaagttattttaaaggaataaaagcgcaaaaatcactcggatgattcgcatgagctcttccttcattggtcaacctaatgaaaaaggaggagtttatgcgttttttcttatgttcgattttcatgatgatttcaccgatttggccgctcggcgaaaatccgctgccgggtgatccgtatgttattgtcaacaagcgaacaaatgaacttgctgttatcctcgacaacaaagtagaaggcgtgtatagtgtggcgactggaaaaacagatgatttgacgcctgaaggagagttttcggtaacggtaaaagcggaaaatccttactacagaaagaaaaatattgaagggggatctcctgataacccgcttggggcaagatggatcggatttgacgcgaaaggaacggacgggcggatttatggaattcatgggacaaaccgagagaaatcagtaggaaaatttgtgtctaacggctgtatacgtatgcataacgatgaggttgttcatttgtttcaaacgataccagtaggaacgagaatgctgatcacggacgacaaccgctcttttgaggagattgccatcgagcataaagctctgataaaaaagcaggatattcccattgaataaggcgcctgcttttttatcgttatagaaacatgacgattcctgagagtacagttgaaagaataaaaactcccaaaatcacgatcaaaacgcttttcatcagtttttgagacatgattttcactccttaaacaatctgtctatattttagcgtgttttgaatgggcggacaagcgatatctattagcgaaagcagggatgaaaatgaacaggcttgaccatatcgggatagccgttttttcgataaaagatgcaagaagcttttatgaaaatgtattggggcttgcatttcttcatcaagaaacggttgaagagcaaaaggtgaatgttgctttttttcaagctggtagcgtcaaacttgagctgatagagccgttgacagctgacagccccgtccatttatttttggagaagaaagggcagggactgcatcatattgcgtttttgtgcaactgcctatctgaacagcttcaagcattgtctgatcagcatgttcaattgattgacaggtttccaagacagggagcgaacgggaaaaagatcgcgtttatttcccctcgggaaacaaacggtgttcttgtagagctttgtgaaccgaaaggagaccaacacaatgagcatgaatgagcacatggatcatttatacacgaaacgcaagcaggcagaagaaggcggaggacgggaaaagctggctcagcagcggcaaaagggcaagctcactgctcgggaaaggatcatatttcttctagatcaggacagctttatcgaattacaccccttcatggaaagtcaagtgttaacaagagaacagcgcatgttaggggatggggtcgtgacagggtacggcacaattgacggtcgctcagtttatgtatttgcgcaagacttcacagtgtacggaggggcgcttggcgaaacccatgccaggaaaatctgcgctttgatggatctggcagcaaaaaataaggcgccgattatcgggctgaatgactcaggtggtgcgagaattcaagagggtgtgttatcattagatggatacggtcacatattttaccgaaacgtcttatattccggagtcattccgcaaatatcggttattttagggccgtgcgctggaggcgctgtatattctccggcactcacagattttatatttatggctgaacagaccggccggatgtttattaccggcccgaaggtgattgaaaaagtgacaggggaacaggttgatgcggagagcttaggcggagcggggatacataatgccgtcagcggaaacgcccacttttccgggcatacggagaaggaggttctgacaggggtgagaaaactgctgtcttatttgccgctgaatggccggacaacagagccgaagccagagaaagaggcgtccagaccgttattaaaccgtcttgtccctgctgatacgacaaagccttatgatgttcggaaggtgattagggagctggctgatccgcaatctttttttgagattcagccattttttgcgaagaacattgtcattgggtttgcaaggctgggtgaaaaagcaatcggcatcgtggcgagccagccgaagcatctggcgggaagcctgacgattgacgctgctgataaagcagcaaggttcatccgtttttgtgacgcatttgatatcccgctattgactgtcgaagatgtcccggggtttctgccgggtattcagcaagagcacaatggaatcatcaggcatggagcaaaattattgtttgcttatgctgaagcgactgtcccaaaagtcacactcatcattagaaaagcgtacggcggcgcctatgtggccatgaacagcaaagcgatcggagcggaccttgtgtttgcatggccgaatgctgaaatcgcagtgatgggtccagaaggtgcggcatcgattttgtatgaaaaggaaatcaaagcttcagctgacccgcaaaagacgaaacgcgaaaaaacagctgaatacaaaaagcaaaacgccggcccatacaaagcggccgcttgtggaatggtcgatgacatcattttgccggaagaatcaaggggaaaactgattcaagcttttcatatgcttgcacataagacagaagagagaccgaaaaaaaagcacggtaacataccgctttaatatggagggacttacaaatggtgaatgaaaaacgcctgctggaagaatttttagagcttgtccaaattgactcagaaacaaagcacgaagctgaaatctgcaaagtgctgaaacgaaaattttctgatttaggtgtggacgttaaagaagacgatacaatggatatcacgggccacggagccggtaacctgatttgcacgctaaaagggacaaaacaaacagatacgatctattttacatctcatatggacacagttgtacccggaaacggcgtaaaaccagttgtagagaacggttacgtcaaaactgacggcacgacgattttaggcgctgatgataaagcgggattggctgcaatgtttgaggcgattaaggtgctgaaagaagaaaacattgaacacggcacgattgaattcatcatcacagtaggggaagaatcgggtctgatcggagcgaaggctcttgaccgttctatgatcactgcatcctacggctatgcccttgattcagacggaaaagttggaaatatcattgtggccgcgccgacacaggcgaaggtaagagcggcaattttcgggaaaaccgctcacgccggggttgaacctgaaaaaggcatttcagcgattacaatcgctagcaaagccatttcaaaaatgccattgggccgtatcgatgaagaaacaacagctaatatcggccggtttgaaggcggcacacaaacaaacattgtgtgcgacgaagttcatattcttgctgaagcgcgctctttagttcctgagaaaatggaagctcaggttcaaaaaatgaaagctgcttttgaagaggcagctgctgatatgggcggacgcgcagaagtcgaaattgaggttatgtatccgggctttaaatatcaagacggcgaccaagttgttgaaatcgcgaaaaaagcggctgctaaaatcggacgtccaagcgagctgcaaacgagcggcggcggaagcgacgcgaacgtaatcgctggtcatggcatcccgacggtcaatcttgctgtcggttatgagcaaatccatacaaaaaatgaaaaaatgccgatcgaagagctcgttaaaacggcagaaatggttgttgccattattgaagaggcggcaaaataaaaaaagaaaacccgagtgcgatttcccgcatcgggtttttttagctccatttcctaagcggccaaaataacacatcctgttttttagcataatgaagcaaggggtctgactccggcaatgtaataccgtgagcatcagtcaccgtattgactgaaatttctgcttcggcgttttgcagcagccacggatgatgatggatgtcttcgtaatagagcttattgcgataagtggtgtagagcctgtatcgttctgtcagccagtaatcgagcgaatccttttctgctgtaaaaggcgctgaaatgggccggtatgcggcgtggaatgctgcttctttgtcatttttccgcttgctgacatagtcaatggcatcaccgtttttttcggacttcatatccgcgtaaaaataaggcagatgaaagaatgtgcgagcgccaaggaccgccagacgatgatcggcatctaagctaaaaaaataaatgccgggcttgcctttatacgtgacataggtgcggaggttaagctcaggaaatgcacgcgcaccgggaatgacagggagataacgcgccctcaggttcgtgagcataaagggaagcatgctgatccaagcttgcccgttatatgtatctaattctaaaacggacggtaccaaagcgcgaaggatagaaacatcaacaggccagtgagcaaataagacatcattccaggtttgtctcatgatccagattccatcaggtacagaaatatttttttgctgaaagcgttccgtcaacgtatatgctcctttcggttggaggtgagtaaaggtattcccgatttccttctttttaaacgatacggctattttttaggatggccatttctgcttcagccatgataaacaagactgtttggcgcggtactttgcaagtaacaaaaaacaaccccggcttttcgcacggggttgcttttttatttcaccgactcagtaagagcggctgtttttttacttttatgatgcgtcatctgaaggacgatgttttgcactgtcaaaaacagtccgcttgtaaaccagtacagcggaagggctgccggaacattaagcgagaaaatcgtcatcatcacagggaagatgaacaccatcaattttgcggattgctgcgccgcagggttttgcgggacagcggaatatttcgcgctcagtttttgagcgatataggcttggacaaaatacataatccctgcactaagggacatgagaatatcagattgccctaaactgaaccatagaaacgagtgtgacgcaatttcaggtgttgagcgaatcgcgtaataaagcccaatcataatcggagactgaatcagcattggaagacagcccatcgcaagcgggttgatattatgctcctgatacagcttcatcatttccatttgcagttctttttgcttttccgggtccttcgtctttttcaatttaacctggatactgtcaacctgaggtttaataacggccattttctcttggaagatgcgctgttttttgaactgattgacaaacaaaggcaatacaactatacgcacaataatggttacgaggataatagagagtccgtattctccgtgaaacagcccggcaacacccttaagcagagcggaaaacggttcgattaaataatcgtggaaaaaacctacgttgctgaggcctcccacctgattagtcgctgcaaatgcagcattgcccgagcataatacgatcaaaaagatacccatagccaaaagtttttgatatgtttttaacaattttgttctcctcctttttataaatgcggtttataaaagaagagaaccggcgtcttcctcatcattcacaggcgaattcatgcggaagactttacgtatccaagttgtaatgcgatgatatataataataagaaagtctgttcggttaatgtgaaagaccgtctgatgttcatctgttcgttttgatttccattgctcgcccgcacggcactcccgtaagaggaatgcaatcccgattgccgttagagcaggaagaataattgtgaaaaaatcgactaagaataaaacgtcatttatcgattccacaaacattgtcatcacatccattcaatagcttcattttactatatgtacaagctgttgtctaatgaccgaaaaggagatttgtttatgccgggaaagagccgaattattttccatattgatatgaatagcttttatgcgtcggttgaaatggcatatgatccggctctccggggaaagccggtcgcagttgccggaaacgtaaaagagcgaaagggcattgtggtaacatgcagctatgaagcaagagcgcgcggcgtcaaaacaacgatgccggtttggcaagcgaagcgccattgtcctgagctcatcgttcttccgccgaactttgaccgctatagaaactcttcacgagcgatgtttaccattcttcgtgaatatactgacctggtggagcctgtctccatcgacgaaggctatatggacatgaccgatacaccatacagcagccgcgctctagagacggcaaaagaaatccaaagcaggctgcaaaaagagctgctgctcccgtcaagcatagggattgcgccgaataaatttctcgctaagatggcgtctgatatgaaaaaaccgcttggaattacgatcttaagaaagaggcaagtgcctgatatcctgtggccgcttcctgttggagagatgcacggagtcggcaaaaagacagcggaaaaactgaagggactcggcatccatacaatcggagagctagctgcagctgatgaacacttgctgaagcgcctgcttggcatcaacggtccgcgccttaaaaataaagcaaatggcattcaccatgcgccggttgacccggagcgcatttacgaatttaaaagcgtcggcaactcatcgacactttcccatgattccagtgatgaagaagagctgttaggcgtctttagaaagcttgccgcttctgtgagtgaccgtttacagcgcaaggaagtcatggcttcgaagctttttattatgattagatatgcggattggaaaaccatcacaagaagcactacgctgagaaacccgattgatcaaaaaaatgacattttgaaagaagcggagcacctcttttttaaacattggaataaaaatcctgtcaggctgcttggcattaccggaacggatttagtagaaaaagagcaggcctataaacagctcgatttgttcagctttaatgaggatgcgaaggatgagcccattcagcagatgatggaaaagttgaataaaaagtacggtaccaaactgatcagaaaaggggcaacgttaaaaaaagaggagagcaaaacaaagggaacaagctttaataaagattttttttaagatgaaaagaaaagctgaatcgcttgaaaaaaagggtgaatgtatggtaatttctttattataaatatcattttattttaatttaaattttaaaatgattaaacgtttgcagaagggacgttagaatatgtcaaaacaacaaatcggcgttatcggacttgcggtcatgggtaaaaatctggctttaaatatcgaaagccggggattttctgtttctgtttacaacagatcaagcagtaaaactgaggagtttttacaggaggcaaaaggaaaaaatgttgttggcacttacagcattgaagaatttgtccaatccttggaaacaccgcgcaaaatcttattaatggttaaagcgggaactgcaacagatgcgacaattcaatctcttcttcctcatctagagaaggatgatattttaattgacggcggtaatacatactataaggatacacagcgccgtaacaaagaactcgctgaaagcggcattcattttatcggaacaggcgtttccggcggagaagaaggggcgcttaaaggaccttctatcatgcctggcggacaaaaagaagcacatgagcttgtaaaaccgattcttgaagccatttctgcaaaagttgacggagaaccttgtacgacatatatcggtccggacggcgccggccattacgtaaaaatggtgcacaacggaattgaatacggagatatgcagctgatctctgaatcatatttcattctgaaacaggtgctgggcctttctgctgatgagcttcatgaagttttcgctgaatggaataaaggtgagcttgatagctacctgattgagattacggctgacatcttcacaaaaaaagacgaagagacaggcaaaccgcttgttgatgtgattcttgataaagcaggccaaaaaggaacaggaaaatggacaagccaaagcgcacttgacttaggcgttccgcttccgattattactgaatctgtattcgcacgctttatctcagctatgaaggaagagcgtgtaaaagcgagcggacttctttcaggaccagaagtgaagcctgttacagaaaataaagaagagctgattgaagcggtcagaaaagcgttgttcatgagtaaaatctgttcatacgcgcaaggatttgcccaaatgaaagctgcttctgaagaatacaactgggatctgaaatatggtgaaatcgctatgatcttccgcggtggttgcatcattcgcgcggcattccttcagaagatcaaagaagcttacgatcgcgagcctgagcttgacaacctgcttcttgacagctatttcaagaatattgtagaaagctatcaaggagcgcttcgccaagtgatttcacttgcagttgcccaaggtgtgccggtgccatcattctcaagcgcattagcctactatgacagctaccgcacagccgtactgcctgcaaacttaatccaagcacagcgcgactactttggcgctcatacttatgagcgtactgacaaagaaggcatcttccatactgaatggatgaagtaatcaatagaaacccccgaagctcttaagctttgggggttttgttattaaggagattgttatacctttgttcagcgtaaaaaagccgaaaatgcttgtaaacattttcggcttttttcttcttattatatattccaccagtgtaagccgtctttcgccaaaagatcatcagattctttcggtcccatcgagcctgattcgtagttaggagataaggttttgtttgctgcccatgtttcagaaatagagtcgacaaagctccaagaaagggcaacttcatcccagtgtgcaaagtttgttgcatcgccaagaagacagtcgtgaattagtttttcatatgcttcaggggtgttcaactcgtcattgcaattgctgcaataatcgagtttgattggttgtgcgtgtgctgctccgccaagctttttagcatttaagtaaagcgtaatgccttcgtcaggctgaatatgaatgacaagcaagttcggattcatgttgttttcattaccgtagtacaggttcatcggaatgtccttaaattgaacgacaatttttgtggacttttctttcattcgttttccggttctgatgtagaatggaacaccagcccatctaaagttgtcgatcaagagcttgccggcaacaaaggtttctgtattggagtcaggagcgacattatcctcatcgttataagcaggaaccggtacaccgtcaatttcaccagcttgatattgtccgcgcacaaagtattcatccacttcgtcttttgctataggacgcagtgctctcagcaccttcactttttcgctgcggatttcttctgtgttcaatttgataggcggctccattgcaagaagggcaaccatctgcataatatggttttgcaccatgtcgcgaagggcgcctgatttttcgtaatatcttgcgcggtcttcaacgcctagtgattcgctagatgtgatttgaatgtttgaaatgtagcggtttgtccaaagcggttcgaaaatcgcattggcaaatcgaatcacttcaatgttctgaaccatttgtttgcctagataatggtcgattctgtaaatttgatcttccgtaaatgcttcgcggatttctttattcaatgcctgtgcgcttggcagatcatggccgaacggtttttcgatgacaaggcgggaccagccggttgtagctgttacaccctctgattttaatgtttttgcaatcgttccgaagaattcaggagccattgccaagtagaacattctgttgttaggaatttgatatgtatcttccagctggttaagcaatacgttaagctcttgataagaaccagggtttgtcacgtcaaacgggtgatagtaaaaatgagacgtgaaatcatctatatgcttatctgcagatgaggaaatggatgttttaacagtttggcgaagatcctcattagaccaaggtcttcttccaactcctaccactgcaaactcttctccgatttgtccgttttgatataaacggtgaatagacggatacaattttcgttttgctaaatctccagttgcaccgaatataacaattactgcttttggttgttggtttgttttcactaaaagtacctcactttattcgaagctttattttagtacaccccgtatatttccttcattttaaatctaaaattcaacgaaagcaaacatttaagcccttttttaagcagaatgctgaaaaaatgtttctagcacgaaaggattgttcttttcagaggcaagattcacattttgcgcttgatcctgtattcttgtaggtatctggttctagtaggaggaaggaaacgtggaattactttttttagggacgggagccggcattcccgccaaggcgagaaacgtcacctctgtagcattaaaattgcttgaagaaaggcgttcggtatggctttttgactgcggggaagccacacagcatcaaattttacatacaacgattaaacctcgtaaaatagagaaaatctttattacacacatgcacggcgatcatgtatacggacttccggggcttctggggagccgttcttttcaaggcggagaggacgagctgacagtgtacggacctaaagggatcaaggcgtttattgaaacaagccttgccgtcacgaagacccatttgacatacccgcttgcgatccaggaaattgaagaaggaatcgtgtttgaggacgatcagtttattgtcacagcggtatctgttattcatggagtggaagctttcgggtaccgtgtgcaggaaaaagacgtaccgggttccttgaaggctgatgtattaaaagaaatgaacatcccgcccggacctgtatatcagaaaatcaaaaaaggcgaaacggtaacgcttgaagacggacgaatcatcaatgggaatgattttctggagcctcccaaaaagggaagatctgttgtgttctccggtgatacgagagtaagtgacaaactaaaagagcttgcgagggattgtgatgtgcttgttcatgaagcaacctttgctaaggaagaccgtaaacttgcttatgattattatcacagtacaacggaacaagcggctgtaacagcgaaagaagcaagggcgaagcagctcattttaacccatatcagcgcaagatatcagggagatgcttctttggagcttcaaaaagaagcggttgacgttttccccaatagcgtggcggcatatgatttcttagaggtaaatgtcccgcgaggctgaaggcggagctcttatttgacaatttgtgatgatgttgtataataaaacgtaatcattacgctttataaggagatgttaattatgagagtaaatgttactttagcctgcactgaaacgggagaccgaaactacatcacaacaaaaaataaacgcaccaatccagaccgtttggagctgaaaaaatattcaccgcgtttaaagaaatatacccttcaccgtgaaacaaaataatataaaagaccgggaatcccttacggcccggtctttttttacgttaattgactgcctggtaaagaggagcggcctgctggcacgctgcgcaccatacgtcataaatagccaagtgaacgatatgaggttcatcatgatggatgttgtgggagctgtttttagcttgaatccagccgctttggttagatagagacaatatgctgctgtgcaagttttgccactcctgttcagcagcgaatttctcagtccgttctcctgatgacaacacaagaagaggcatgtttcctaagtggacttgccgctttttgagctcctgcagactttttgaaaactctgcatgtgtgccctcaagcatcatctttctcgtatgtgatttgtgcatttcttcgggtataaaggtaaagctggcgcaatcgcctaaagctgggtcaagaaggaccatgccgataatatcatgcttgtttttgcaggcccataaaccggtgatgacagctccgtatgagtgtgaaacagccaaataaggaggttttacatcagctgctttaagcaaactctccaattctttcacttgttgatcagctgttcgtttagctctgctttgcccgctttttcctatgcctgcccgatcatatgtgaaaatgccaaattcatcatcaatgtccgccattaatggtttccacgtctcagaagaagtaccatagccggcctcaaagacaatcgttacaccgcttgatcctttccggtgctgtgtatgaaacgcacatccgtcaattgtatatgtcttttccatccaagctgatttcattggagtcatctcctctaattggttctactagggagacggagaaccttagccgatcgtttctctaaaaataaaaaaagagatatcctctacaggatatctcttatggcattaccagcctctttcgtattgaacaggggccggaatctctgtattgagctgtttcgcagcagttcttgcaaagaatggatcccgcaaaagctctctgccgataaagatgaggtcggcacgtccgttttgcagaatttcttcagccattgaaccgtctgtaatcatgccgacggcaccagtagccatgtccgcctgttcacggattttctcagcgaagctgacctgatagccagggaatacgttaatgtctgcgtgaacaagggcgcctgagctgcagtcaattaagtcaacaccctgctccttcatccattttgcaaaaccgatgtgatcggcaatgtctaagcctttatcagtgtagtcagaagcagatacacggacaaataaaggaccgtcccatacttgtttgacttcatcaatgatctctctcaagaaacgatagcggttttcaggtgagccgccatattcatctgtgcgatggttggaaagcggagacaaaaattcatgaattaaatatccgtgcgccgcatgaatttcaatcacatcaaagccggcttcttttgcgcgggcagccgcttgcttgaactcctggaccgtttcttttactttttctgctgacatttctacaggtgttgctgattgttcgtcaaacgcaatcgccgatggagcgaagatatctccttcaagctcagctttacgtccggcatgggcaagctgaatgccgatttttgaaccttgttctttgacctgctcagtcagttttgcaaagccttcaatatgctcgtcgctccaaatgcctaagtcttggtcagtgattcgtccttgagggttaaccgctgacgcctctacaataatcagtccgacctggccgattgcgcgcgatatgtaatgtgccatgtggaacggtgttaattttccgtccttttcatgagaagaatacatgcacattggcgacatgacaatgcggttttttaacgtcatatctttaattgtaataggtgtaaataattttctggccatttctttcgcctcccgtaaggtttttagagattgattatatcaagtcatttctttcccgtcatataaactgctcaaatgaaccgcttttgtcaaacatttctgtataatagacgagaaatcagtttatttttcagtatagaagcatttttattcataggaggggcggaataaatgaattggcagacgaaggacgaattgctggcacttttaacttctcttgtgcaatacgaaagcatcaccggttcaaagggcgaggcagcgcttgcagagtatctttattttattttgaaggacaagccctattttcaaaagcaccctgatgatgtaacacttcatccgatggacgatggcagatcttttcttacggctctagtcaaaaagaagaatgtcaaaaagacagtgcttctgctgagtcattttgatgtcgttgacatagaagattacggcgaatttaaacatatggcttgcaagcctgctgagcttttgagctcctttttagagaaaaaagagctgctcccggaacgggtgagaagagatgccgaaagcggagactggctgttcggaagagggacgatggatatgaaagcggggctttgtgttcaactgtcgatgctggagagggcaatgaacggacattttgagggcaatctgctgttgataacggttccggacgaggaagtgaattcaagaggcatgattgaagcggttcctgcattgaaggaaatggagaaaaagcatgatatcacattaaccgcttgcctgaatgccgaaccgatgtttgaaaaatttcccggcgatcagcagcaatatttttatacaggaagcattggaaaggtgcttgcgggttttttctgcaaggggattgagacacatgttggagagccgttttcaggcctaaacgcaaatttaatggtatctgagattaaccgtttgcttgaactgaatgctgattattgcgaaaaggttgatggcgaggtcactccgccgccggtaaacttaatgcaaaaggacttgaaagaggcatattcagtccagacaccgcatacagctgtcacattatttaatgtgctgtcaatgaaacgctcagctagtgagctgcatcagatgctgcttaaaacagcagaacaggcggcagaggaaatcatgtcgaacgttcggaagaaaacacaggattttcaacaatttgagccatttcagccgattgagcgggatgtcactgttttgacatttgatgagctggtctcgcgtgcaaaaaagcgtgcggggatctcggaaacagagcgggctctaaattatgcctttgctaacaggggcgagcttggagacagggatttttcgacgaaaattgtttctcagcttgcttcgctttgtaaggaggatgcgccgctcatcgttctgttttatagtccgccgctttatccagctgtttcttcaaaggatgatcaattgatcagaaatacagcagatcagttaaagcattatgcggctgagcgatacggcattgcattacgggaggttcagtacttccccggactttcggacttgagttatcttcagctggaaaagcaggaggttgatgcatacacaagcaatatgccgctctttaacagaggatattcattgccaagcggtaaaaatcaggctttatatgtcccagttttaaatgtcggtccggctggtaaagacccgcataaatggacggaaagattgtatatgccttattcctttgaagtgcttcccgatttgctttcatttacgatctccgcgctattaaagcaatcagaatctgccggccagctgctgcgggaaaaataaaaaacagaaggcactgtgccttctgtttttgtccttacatctaagaatgtctctctaaggcggcaccggcaaactgttctttgatttctgcgctccgtttagctgtttcttcaatacagtgaataattgcttcttcaaagcgggagtcctgtaaagcgcgaagacctgcctctgtagtgcccccaggactggtgatttctttacgcagcttttccggctgtttgccgctttgaaggagcatatctgttgcccctgccattgtctgcaaaatgagtgcttttgccgtttctttatctaatcctactttttgtgctgctttttccatcgcctcaatataacgatacacataggccgggccgctgcctgcgattgcagtgacagcgtcaagatgccgctcctcaaccagtgttgcatcaccgattgtttccaatagagcttttgcggcaataatatcattcttgcttgcttccgtgcttacggaaaatccggttgctgattttctgattgccgctgatgtattaggcatgacgcgaatgactgcgagctttctgccaaaataatgctgaatggtttcgatggtaaggcctgcaagtactgaaatgacaagctggtccttgatatacggccggatgctgtcgatgctttccgccgcgtctttcggtttgaaagcgaggataatgatatcggtgtgagtgaaaaactcatttttatctctgcatggacgcacgccgtacgtttcctttaattcaatcagacgctcgtcatttgagcgatttgtaatatagatatgttctggttttgtgatgccgctttgcaaaatgccgttgatcattgcttctgccattgacccggcgccgacaaatcctatctttttcattgatatcctccttctatcagaacaacaaaaaaccttttcatcacgtaaaggacgaaaaggttcgcggtaccaccctcattagcacaaattgtgctcagctcaaatccccgtaacgcgggaaacgtttaggttttcctaaccgcgacttgagggcaggttctacaaacaagcgggccgcaacacctttcagccgggggtatcgctctcttaggccattgccttgtatactattcctcgtcatagcgttccaatggttctcgttttagtttgttgttcattatgcaatggcggacaagctaatgtcaatagctttttcaaaaaggtttgttctcattctgcaataatgacacaagaccgagaaaaagctaaaatatgaataatgaatgaagacaaggagcgaaaggatgacaactgaagatgtaattgcgatccgcgtcccgacgccgtttgctgtcggcgatgttatcgtttacctcgtaaaaggtgatgcgctgacacttatcgatgccgggccgaatacaaaagaggctgccagagccctacaagagcagcttgccgctgtaaatgtgaaaatatcagatatcgagcaggttgtactgactcaccatcatgctgaccatgcaggcttgcttgatgtcttttcagatgaaatcgaagtgattgggcatgcgttcaacgaaccttatatcagccgaaatcaagcctttatggattggcaaaaacgtttttttcaaaagctgctgcctgaattaggcgttccatttgatacggggaaggtagaaaagctgattcgatcagcgtacgcattttcctgtacgagatctctgacaaaatcaattagagaaggtatgggcatagatgggcttgagggctggtctgtattggagatgcctggacatgctgaatcgcatatcgttctgttccatgaaaaaagcggaaggatgcttggcggcgatctactgctggcaaacagctcgtctaatccgattttggaagcaccgaaagcgggtgacgtcaggtcaaagcctttagtggattatcagcggtcattgcgaaggctgtctcaacttgatccaacaatcgtatttcctggtcacggcgagcctatcaccagtgtacaagcgctgattgagaagcgttttgacaagcagaggaacaggacggaggatgtgcgtcgcatgctggatgaaaagccgatgaccgcttttcaggtctgtcagcagctttttcctgctgtatatgaaaaggaattgtttttaacgatgtcagaaacggcaggtcaccttgatgtgttggaggctgaagaagccatcacgtcatattgggaaggaaataccgcatactttaaaacaatgaagaggtgaaatgggtgaaacatatagcgggaaaaaggatttggataaccggcgcttcaggagggcttggtgaaagaatcgcatacttatgcgcggctgaaggagcccatgtccttctgtcggctagacgcgaggatcgtttgatagaaatcaaaaggaaaataaccgaggaatggagcggacagtgtgagatttttcctctggatgtcggccgcctagaggatatcgcccgggtccgcgatcagatcggctcggttgatgtactgattaacaatgcgggcttcggtatatttgaaacggttttagactctacattggatgacatgaaagcgatgtttgatgtgaatgtcttcggcctgatcgcctgtacaaaagcggtgcttccgcaaatgcttgagcaaaaaaagggccatatcatcaatatcgcctctcaagcggggaaaatcgcaacaccgaagtcgagcctgtattccgcgaccaaacatgccgtgttaggttactcaaacgctttgcggatggagctttcgggaaccggcatttatgtgacaacagtcaacccgggaccgattcagacggactttttttccattgctgataaaggcggggactacgccaaaaatgtcggccgctggatgcttgatcctgatgacgtggcagctcaaattacagctgcaatttttacgaaaaagcgggagatcaatcttccgcgtttaatgaatgccggcactaagctgtatcagctgtttccagctcttgtagaaaagctggcaggacgcgcgctcatgaaaaaataatgatggaactgcctgtggtggagtggcttgtttctcacgaggcagcttttgatagtggaagggagagattgttgaatgtcagttcattcagaagtccttcatgctctgcttaaagatccgtttattcagaaactgattgatgcagagcctgtattctgggcaaattcaggcaagaaagaggggccaataccccgtgcagatgagtgggcaaccgagatagcggaagcggaaaaaagaatgcagcggtttgcaccttacattgccgaggtgtttcctgagacgaaaggcgctaaaggaatcatcgagtctccgctttttgaggtgcagcatatgaagggaaagctggaagcggcatatcaacagccatttcccggaagatggcttttaaagtgcgaccatgagcttccgatttcaggatcgattaaagcgaggggcgggatttatgaagtgttaaagcatgctgaaaatctcgcgcttcaagaagggatgcttcaggaaaccgatgattaccgcatcttacaggaagagcggtttaccgggtttttctcccgctattcgattgctgtcggttcgacaggaaatctaggtttaagcatcggcatcatcggcgcggcactcggctttcgcgtgacagtgcatatgtccgccgatgctaagcagtggaaaaaggatctcctccgccaaaagggagtcactgttatggagtacgaaacagattacagcgaagcggtgaacgaggggagacggcaggcggaacaagatccattctgttattttattgatgatgaacattctcgtcagctgttcttaggatatgctgttgccgcaagccgattaaaaacacagcttgactgtatgaatataaagccaagtcttgagacgcccttgtttgtgtatctgccgtgcggagtcggcggaggaccgggcggtgtagcatttgggctgaagcttttatacggagatcatgttcatgtgtttttcgcagaaccaactcattcaccttgtatgctgttagggctttattcaggacttcacgaaaagatctccgtccaggatatcggcctggataatcagactgctgctgacggacttgccgtagggagaccgtcaggatttgtcggcaagctgattgaaccgcttctgagcggctgttatacggtagaggacaatacgctttatactttgcttcatatgttggctgtatctgaagataaatatttagagccctcggctcttgccggcatgttcgggccggttcagcttcttacgacagaagagggaaggcactatgctcagaaatataagatggaacatgccgtacatgtcgtctggggaacgggaggaagcatggttccaaaagatgaaatggctgcgaataaccgaatcggtgctgatttgctaaaaaaacgaaatgaaaaataagcagacagtgaaaaggttttccgttacaatctttgtaagggttttaacctacagagagtcaggtgtaaacagtgaaaaataaagaacttaacctacatactttatatacacagcacaatcgggagtcttggtctggttttggggggcatttgtcgattgctgtatctgaagaagaggcaaaagctgtggaaggattgaatgattatctatctgttgaagaagtggagacgatctatattccgcttgttcgcttgcttcatttacatgtcaagtctgcggctgaacgcaataagcatgtcaatgtttttttgaagcacccacattcagccaaaattccgtttattatcggcattgctggcagtgtcgcagtcggaaaaagcacgacggcgcggatcttgcagaagctgctttcgcgtttgcctgaccgtccaaaagtgagccttatcacgacagatggttttttatttcctactgccgagctgaaaaagaaaaatatgatgtcaagaaaaggatttcctgaaagctatgatgtaaaggcgctgctcgaatttttgaatgacttaaaatcaggaaaggacagcgtaaaggccccggtgtattcccatctaacctatgaccgcgaggaaggtgtgttcgaggttgtagaacaggcggatattgtgattattgaaggcattaatgttcttcagtcgcccaccttggaggatgaccgggaaaacccgcgtatttttgtttccgatttctttgatttttcgatttatgtggatgcggaggaaagccggattttcacttggtatttagagcgttttcgcctgcttcgggaaacagcttttcaaaatcctgattcatattttcataaatttaaagacttgtccgatcaggaggctgacgagatggcagcctcgatttgggagagtgtcaaccggccgaatttatatgaaaatattttgccgactaaattcaggtcagatctcattttgcgtaagggagacgggcataaggtcgaggaagtgctggtaaggagggtatgaaattgtgcatcatattgaactgtatgtctctgatttggaggcgtctaggcggttttggggctggttcttaaaagaacttggttataaagagtatcaaaaatggagctcaggcatcagctggaagaaagatcgtttttacctagtgattgtgcaggcgaaagagtcatttctagagccgaaataccatagatgccgagtcggtctgaaccatctcgcatttcatgctgaatccaagcttcaagtcgatcagatgactgaaaaattgacggcaaaaggttatcgtgtgttgtaccgagacaggcatccttttgccggaggagacgggcattatgcagtcttttgtgaggatccagaccggattaaggtagagctcgttgccccaagctgttaatcgtgatcttcggacaggctgttcagctttttctcaatgcgatccagctgcgcttttcggtttttcgcatacttgaagcctgtaacagccgcaaagatgacagcggcaaatataataaatacaatcagatgaaacatcacatcgcctatattcatgtttttcacctcatgtttgcgggagagattcattttctcccatttttatttagagctgcttttccagacgggaaccgtgttttgtagttcccgttttcatttgccgataggcgaacgctaaaaatggcaggccgagcagggtaatgccgctcaggacagaaaaaatataaatcggccggccagcgccaaataggtctatacatatccccccgacccaagggccgatgacgtttccgagctgtgaaaaaccgattgccccgaaataagtgccttttaatcctggttttgcaatctggtctacatacaaatccatcatagagaataaaagaacttcgccgattgtaaatgtgatgacaatcattacaagtgatggaacaccgtgtgatgcggtgaaaatggccatgctgatgctaaccataacattaccgagcatcagagaacaaagcggcgaaaaccgttttgcaaaatggacaatgggaaattgcgtcgccaacacaacgattgcgtttaatgtcagcatcagcccatacagcttcgttccattgccgatcaaggggttctgcgccatatactgagggaatgtggaactgaattgtgagtagccgaaggtgcatagcgtaatgccgaccaaagcaatggtaaaaagataatccttttgcgtgaccataaacgcttcccgcacgctcatatttcgggactggactggtgctgataaggatggatgttttttaaattggagggcaagcacaattccgtatagtccgtaaatgactgcaggcaccaaaaagggcgtagtcgattgcgatgagccgaaatataggccaagcacaggtccgaagacaacgccgatattaatagctgcatagcgtaaattaaaaactagcagtctcgttttttcttctgtcatatcagacagcaaggcctttgaagcgggctcaaacagtgatttgcaaagaccgtttaatgcgtttactacaaaaaacacccagagattagatgctgccgcaaagcctgcaaataccagcatccatccgaaaatcgatacaagcatcatgttttttctgccgaatttatctgagatatatccgccgtaaaagcttgcgaggatgccgactgatgagctcgcggcgatgaccagccctgcataggaagctgatgcgccttggacggctgtcaaataaatcgctaaaaaaggaatgctcatcgatgttgccattctgccgaaaatggttccgattataattgtccagctgatcgggtggatatctttccatttcttcatgaattatattctctcctgtatgtatgatctttctctatcatatatgaaaaaatttccttctccaatagatcgttcaaaatatttcgttattgacatgtagtatgcctgattgtatggatggcaatatactatgcgttgaggatgcgtgtggctgacggagtttacatcttgaaagaaggaaaatgacgggatgtccgatgaaaagcaaagcgattggtcagtgagggtgtgttagtttaagccgccagaacgtggatcatatcggcagtgaaaccggctatgagatcaagatgtacgctgaaaaccggcatggaccgcatgacagaacaagagagcacatctcttcgaaaaagtgtatacgcgtgatcatagacagcttattccgttttgcgcgagcactgaggggaattttacggcaggccatatgaatctatggagcgtgagaaaatcctgcttttttctgtaagcctgagactgtttatttgtttcaggcggtgttttcaaagggaagccgcatcagcggctgaaagaactgacagtcatgcgtttaagagaacaggccttggtttgtgacatagtcataaatgatatcttctatatgcgcatgcaaatcctcatctggttcttcattccgtctctcttgtagagccgctttcaggctttgtttttcatacgggcttaacggatctatagcaacgtttctgccgtattgccgcaatgcctgttccatcattttttcgacaaatttctccatcatgactctcctatccttatgcttcacttttattctactaaatgtttttcttctctcaaacccttggatcatattttctgtcagacaagaatcatttaccagtataaaacgaacatactttcgcatataatgagaacgaacataagttctttttagaggtgtgtatgatgaaagaaaaagtgatttttctcgttgacatgcaatcgttttatgcatctgtagagaaagcggaaaatccacatttgaaaaataagcctgtcattgtttcgggtgaccctgaaaaaaggggcggagtggtattggctgcctgcccgctggcgaaacaaaaaggtgtggtgaatgcttcacggctgtgggaggcgcaggaaaagtgtcctgaggctgttgtgctccggccgcgtatgcagcggtatattgatgtatcactgcaaattacggccattctcgaggagtatacagaccttgtggagccttattctatcgatgttctgttactattaattacacgatataatcatagtttacaaagttcgactttatcctcaagattatcacataacagctaacaaaaatgtataatataaactgtgagtttggggggaggaaaatattttttgagagattataatggacttgaactaagagttgaattagctaaggcaaaaaacgatctgcgttatatgattactgataatggaataccaatacatgatgcttgtctttggttagattttgtgagtttgaatagttatctcactggcgaaagatatgcatatgcacttttacgttatcttcgctttttaaaagttaataaaattcattataaagaagttgtgaataagactgtaattgaggaatacattaaagatcttcttggcttaggtaacaaaataattgattatgaaagtaaaattacatacaatgcaatgtcactgtatattaccgtagtaaaatctttttatctttggcttgaagatgaaaggaaaataagctttaatccagtacttgtccatagtattgctgacacaaatagaacttttaataaaaccaagttattgtatggacagatatggaagtttgatatagaaacgacactattatcaagagtgacttatcgtaagcaaagagatcatttgaaatggtatacggaaaaagaaatcgaaacaatcagaaaaaacctaccaactattagagatgaagcagttttcgcaattagtgtcgaaacaggaatgagaatcggtgaaattttagggttgaaaatgaatcattttaatccatttgaggccacattagagatagttagagaacggaatattgagaatcggacacaagttaaaacagctgaacgtacaatacatatttacagttcgttaattgatttaatccaagaatatattataactgaaagggcttatgctgatattaattattcgaattttttattcttaaatcttaaaggtaaacatatggggaaacctctaaaacctagaaattttttgcgtatattaaaagattcaggagagaagtcaggtttaaaaaggaacgaaatcagaacgcatagtggcagaagcacaagagttcagcaactagtggaattgatgagagacaaacctgaattaggtattactcaaacatacattgatgaagagcttggatggagaagcgagagaagcataaaaagttatgagaagggatatagtatgagacaaaaacgaaaaattttagagagaataaaaaacgtatcaatcaataaaggagagagtaatatttgatagatataaagctggtcaaatctttaactcctacgaattatataatcgatgtaaaccaaaatattatccatctacgcaatattcaattaaaatatgctgagttagctgaatttataaagaaaattcaagacgtgtttattgaaaggaatataaattccttttacttagtttttaacatccacggtattaaaaattttaaaagtgttgaaaagctttttatttttggatttccgaatcagtttcttgaatttctattatatattggacagcagcatgtagagcagggagtctatttttctgtaacaaaactcctcaagggtttaaactcaagtgatggagtatcaaataggagtaatgatctaaagaactttattacattggttgaaaaagaatatcaggatcaaattattttaccgcaactctttaaagcttttaatactggtgatagaaaaagagtggagcttatttatagatctttatcttattcaaagtttatggatttaagcctaaaagaattaaaacaagaatttgtgtcttatctatattcatgtacagatgccctattcaaaaaaaataaagttgtgttttattcgaatctttattcttttgcatttggtgtgcaatatttacagtatagttatttgtctgaacctctaaagagtttatttactgatttattaaacaataaaaaatactctctagagaaaagcattgttggagttggcttagataaatggtttttgttgattaagaatatacagcaggttaatgtacgggtattaaagtttgattgcttaccaaacaacttgaagttggagattcaacaatatctttttaattggtggcaaaaaggagaaaatgaaaaagcaattgcacggagacacactaatgtaatgaggataggaaatgctctcgttggtactgggataagctttcaatcattgctagatctaacttatgtagatgtactaactattaatgattttttgcagcaactaaaaattaaggggaaaaataaatattcacttaaaaccattcagggatctttctctgaggctcgaatgttatttgattggttaaataaaaaaagaaaccctaataactcattaaataatccttttagacgttttaagtattacaatataaattcgtttgtgaaaaatgcaaagtatattcctgaagaaataattgaacagttaactaatgttattcatgaatgttccagaagtattcaacttatttggctgattatgatgaatacgggaatgagagtttcagaggtattaaatctaacaacagattgtttagtctacgaccaaaaagaaaaaatgtttttcctcaagtttttagcttcaaaaaatttaaaagaacgacgtaaaaaaggtttagatgattttcatacggttcctttgactaatgaggaacttataacaaaaattcgagagcaaattgataatacctctgaccttacggctttaggtaatacaaattttatttttatccttatcgatgatatacatagaagctctataaaacgttatactggcaatatggtttccaatgagattaataaatgtataaaaaaacatcagattaaagatcatacaggtaatctttttcattatgccaatcatcaatgcagaaaaacattagctgtttctttattaagtgagggaagttctatcacagatgtttctcaaatattagggcatttagtagaaaaaacaacccaacaatattatcaagatgttgattcgttaaagatagctaaacttgatcaaaaactttttgaggagttattccatacacttgataaaaaaactgttgaatcttataatcctcatgattttgaacagcttaagcaagaaattatgttaggtgctcgggaaacgcctgaaggtcatggtagctgcgttaaacatgtttcttttggtccttgcaaaaaaaggtcctgtgtgggttgttctttcctgttaactggaccgcaaaaacttcctatgtggagaaaactttatcgagaacaagagaaatatgtttacgatttacgttcgctaatgataaagcagggtatcgaaaactataaagactatagagactttcagcaagagaatcatctgcttaatctgtacaagaatactattgaacagttagaaaaatttatgaaagagagggatttgaatttttaatgaatataaaaaaacagtttcatttaagagagaattattcaaaaaatcttaaagaatttttaatacgtcgtatagaccaacttgggtactttgatttttctgatgactcttggtatttcgaaaagagacataaagattcccttcctaaaggctcctataccttagtttttcatcaggtaccaattcaatataaaaagtcggtgaaatattatgctctcttatgtaataatcaagtaagcaccatacaaaaaaagtgtttaaatattgcccgttttttaaaattcattgtaaagcaatttggttatttagagatagaaaaaataactagacaacatgttaatgcctttgaatattcattgaacctctcttcttattcaatgaacaacaaacaagtgacttatgcttcagttcatgatttctttacaaagatttctgattttgatgaaaaccttaagaacataccatctaaaagaataaatccttttaagcaaagtagatataaaaaagaaaatttaattagttctgaggatcttaaaatctgggatgctcttctgaaagatgaacaattaaatataccattagaatttcgaacattgtattggcttattcgttccttcccaaatcgcattacggaagtattatctatgaaaagggattgtcttaagagtttttatagtgaatatgttattcaaattcccacttttaaacaaagtggaggctatggtaagcctgtaattaaatcaatccctgtagtatatcaaggccatggaaaatacgtaattgacctcattaaaaaacttcaagaacaaactaactcaaatctttctaaatatctaatcgctcaaaatcaaaaacacgactacctttttctttttaggagatggaatttttatgatgacaacggtttaaactttcgttttaatcaaaaatttactaatcaactatataattggacaggaccaaaaataaatgatttgttgaaacaaatgggtttaattatgaacataaggaataaacacaatcaattaataatccccaccactcatcattttcggcatagcgctgtaactgagaggttatataccgttggatatacaattgaacaagttcgacgcctaacaggacataaaaatgaatccatgacaaaattctacactcatcagctggttgaaaagcataagaaaattcatttaggaatttcccaattgagtaaacctcatgaaagtgctgtggaatttaaagggaaaattctgaatttagatgaaaggacaactcaccaattatctaaggatcctaggcgttatttaacgtgggaggctaatgggaaaaaaggtgtcggtatttgcagtgatatttcaggctgtaatcctcaaggtacttcagtgcattttgagtgttatgcatgtgattggtttgtaccgaaaattgaatatctatcagattatagggccgaatatgcttactgggagaaagttattgatagaacttcaggagattctaggcgtgcagcccattttgaaaatgctgtccgcaacctaagttatctcgaaaggattatttccatatgcgaaaatggggtttctcattttaaggaaaagttggtcttaaataaagctaaaaaggatttggaactatataattgggagtgatttttcgtatgcctaatgagggaatcttaatgttgcagcagagaaagagaaacgaaagtattgaaaaagtcaattgggcaattcagtattttcgtgatttagaaggaccaaattctcgaattactgcaaaaaaactctcggagttaacccaattaagccgcacagtgctctataaaccacatttgcgttctctttgggataaaaattggcacggtgagaatataaagatttctaaaaaaaatgaccttactgaggaagataaacttgaaaaaaaaattacttgtttaaaagctgaattacaaaaaaaagacaccaaaattcatcgacttgaagaagcttacaaaaatgaaaagaatcgttcgaaggcacatgctcaagattatgaagagttgaaagttcggcatcaaagattattgcatcataatttgatgttaactagaaaattacacttgcatggtcttgaatatgatgatcagcctgatttataatatggatcaaagaagccgactattttgaaatagtcggcttctaatactaataagacagttcaactgaaataatttgttggtagggtattgttattgcatcttcatcgttaatgatttttaattggtgttgcttaacttgtgtcacccatccccaaaaatgttttttctcataagttgaagcatacgtgatcgtgatagcgcgatcctcgtttatagattgtaaaatgatacgattgatttcatctaattggtcgtcactaagcttgctttggtgaaattctctttctttccgccttttatctagtaataactctcgatgttcaggtagcatcatacggcttgattcccacatgaggttatggcctggtgttaacttattgggattcataaatatcacctcgattatttgtaatgtcctcctattttttcagcacgatggttcgcttggccggcctttgttaaagaagaggcatgaagtaaagaagcaggaccgtactttgtgtgaatttcatcaaatactttactcaagttttcttttttttgatgaagttcaaacaagttaagttgataataccgatctgactgtaattgagaaagggtaattccgatgctccggacaggttggccatcccaatgttgctgaaataattctacggctgcattaaaaatgtccattccgaaatgggtaggagaatctagcttttgttgccgatgaaatcctgagataaaattaaaatcagctccacgaatgcttacagatactgtatgtccaatgtagtgcttaaaacgagctctgcgagccacttcttcacttagttcaagtaaaataaccttaatatcttcaaaggtactgtagtcataaggaagggtcatattatgtccaatcgccttttgttggtcatgtgtgtttactgttacaggggaagggtctattccattggcggttctttgcaaaagttctccattgattccccaacgttttttcagaagtgttatgggatgaactgctaatcctccaattgtgctgattcccattctgtttaaatgtttttccatccgttttcccacaccaaacagcttaccaacaggtaatggccataaatcttgctttaaatttgagaaattcagttcatagatacccgatgtattttttttagcaaaatgatcacacgccattttggccaatactttatttggacctattccaacacgggcataaatacctgttttactcctaatagaggattgtattttttttgcgataacttcaggagcaccaaatagtttagtgcttccagttatatcaaggaattgttcgtcgattgaaaacggttcaactaagtctgtatactgctcaagtaattcagtaatcataacagagacattaatgtattgttgcatgtgaggacgcaagataattgcatttggacattttatttgtgcctcccagagctgttcagcattttttacaccaaattgtttagctatggggcaagcagctaggacaataccgctgcgtctttcgggatcccctgatacgatgacaggctgatttcttaggtgaggtgctgttgatttttctacagaagcgtagaatgactccatatcgacaagaagaatgtttctttcagtcataaaaccactcccgaacgtttgttctatttgtattttaaccgaaatgctgctgaatttatactggtaaataaagcgttcaatggttataaatgataaggagtacacaaagtttttcgaaaaaatggaagtctagaaaaatatgtcgattataatgataaaggagcaaaacaaatatgtgattaacaaggaggaaagtatgtatatatctcaagttcatattcaaaattataggagctttaatgattttaaaataagcttaaatgaaggattgtccataataataggcgaaaataatgttggaaaatcaaatttcttagaaagcctcaatttagtttttaatagaaactattcattagctaaaaagactttgcagcaagaagatttttggagtggcttaatcattaaggataaatggccagaggttaaaatagaaataacactgagaggcattaagacagaagatgaactagctgtgactagtaagtggttaactagaaatccagaagaagcaaagctcacttataaatttaggcctaaatcaaatatttctgccaaacttccaaaaaagtctaagtccatcagtgaaattcaacttccattacacgagtacgaatgggtgatttatggaggggaaattgaaacaactgatgcatttgattttaacatgttagctaagtttgggattgagtacgtaggagcactaagagatgcgacgtctgaattaaaaaagtcatcagggcaattacaacagatattaaaaagtcttgatataaaagagaatgaattagacaggatatctaaaaaattagaagaactaaataaagaaattataaaaggtaacggtgtgcaagagacacaagctcatattaataggttcttggggaaaattactggtttttcaagacaagaagtaaagatacaaatgagcgaaaatgattatgcttctcttctaagggatttgaaggttttaattggatcggtcggcgaaaatgcgcatccagttaatataaacggattaggctataacaatttactctacataagcatgctattaacaaaatttacaactctaaaagagttaaaacagaattcaaactatctatttcctattttaattgttgaagaaccagaagcgcacctccatacgcatttacaaaaatacttagctaaatatttttttgggcaagaagtagttggacaagtaattatgacaacacattccactcatgtgagttctcatgcagatttagacagtttaattgttttttataagaaatctggaagaaactattcaagaagaattggtacaatttttgattcgaacaataaagagcaaagggaatataaacaacacttgaaaaggtggctggacgcaactaaatccgacattttctttgggaaaaaagttttattattagaaggtattgcagaacggctattaatgccaaagtttttttctatattgtacaactctaaagataatggttcaggttgggagaataccttggaaagtgagggaatatccttaatttcagtagacggggtagcatttaggccattcttacagttgtttagcgataaaggattggatataaagtgtgcagttttaacggatagtgatccagaagctattccagtgagaaatgaaaacggagaagaagttcgagggatggatggtaagattcttaaggaaaaagtttatccctttaaagaaggtcaatatgaaatatgctcgagaacagcgaaccttaaatcagactattgtgaacaagaaaatgtatatatatcaaccaatttaaaaacctttgaatatgatttaattttagaaaataatcaacaattctttcttgagttaattgaaaaacacaaaataggaacagctaaagatcgtacaatcattagagatttagaaggtcacgagtttgccaaagaagcctatgaattaatctcaaaagaaaaaggtcagttttctcaatatatattagatgaattaaacgatggaaaaacgattaatgtaccattatatattagaaaagcctttgaatttcttaaagaacgggatgaatctgatgatactaatagataatgaaaagtacaggcgagaaattatagaacaacccatagaaaattcaattgttgtacatgcaggacctgggagcggtaaaacaactttactgatccaaagattaaaatatataattgaaaatcgcaaaaagtcttactctggaattgcatgtattacttatacaaatgcagcaaaagacgagattatatcaagattgcaaaaggaacaaattgtgcccccaaaagagttctttattggaacaattcattcatttctatatgagaatgttataaaaccatattctcatttgttaaatcagaatgaacaatttaaggttacaccaattggttttgtaagaggattaaagagagaagtgggtgagattttaaataagcctcagtacagtataagagaaagtgaattagcagcttttgaaagtttgggacatgataaagatggtcgtccttattgctttagaggaaaaataccttcacaggtagctagggaatggaaaaaaatgttgaaacagaaggggtacatagatcaacaaacagcaatctatgtttcttataaaattttaaaaaaatatgagcacataaaaaaagctttcagtttacgttttccgtttatattaatggatgaatatcaagatgtaacatattatcaagataaagtgttctccttgttaacgcattcttcatttttttgtgtaggagatgctaaccaatctatatttagctttacgggagcagagccaattatttttacgtctaaggataaagatgaaaaattcaaaaggtataatttaattaataattttcgaagtacgagtaatattgtacagtttaccaatcgaaaaacggatattatccaaaatgatgctagtgaacatacatccttaaaggaaaaagttttatttataacaaataaaaaagaaatgaaagaagttattgaaatttttcaaagagaacaagcaaagataaaaattgatgaaggtcacatcccatttctaatattaacgaggcaaaataaacttcataagcagataaaccaaattattaaagaaagtaacttcgaggtgaacccatttttagataaattaaagagctatcactataggagatatcttatactaaaaaatcttttaatcgctattgctttcaaaaagagcaaccaattagatgaggcaataacttatatttcagaaagcttaagttatctcttcttcaatgctcctccagcgtatattaagttaaccgacattcaatatgatgcttttatgtggaagaaattaaatgtattcacaatactttatatagatagcttagaccttaatcaaatgactccagataaactgtttgtggggctgaaagaatttataggtgaaacatctgaaaaggtatttgagagaaaagtaaatagaaagttgaggatgctcgattatgattggaaggggtcaaaaaaagacgtaaaaacaattaaactgtctgaactggttgaaagcctattgtatgaacatcaatacactcagaaattaagtaatattaagagtatacattcagctaaagggatggaggccgaatgtgtattagtactagctgaaacacaaaatgaacttaacgagtggttggctaataatcaaaagtcagaagaggccagaatagggtatgtagcgttttctagggcaagaaaactcctatgtatatgggcgccttcattaaaagctgaagaactcgagtatttgcaagacaacgtaaagtttatatagagaaataaaggttgaaaaaactgataaatgaaaatcagttttttcaacctttatttttttcgttaaattcaaggacaacttttgatatttgatttatcagctctatttcagaaatagacctagtagacaaaaattcggtatgctcctttaattttgctaattgaatattttctgtgaaaaaaaacattgagggagtgatctcaaggacttcaagcaatcgatccagtgtatccaacgttatgtttctctcaccacgctccacacctgctatatacgagctctgaaaaccggatttttctgcaaaaatttcttgtgtccagccctttgcttttcttaaatctcttattttgtgaccaacaaataaaattagctcattcattcttaactcacctctctctcaagattagagagaggtgagttaagttaacagataatcaaagtgtaatattaccattgaaaattgtacttataagtactatattgttttttatgttttattgttcgcttaaggaggtcaattttttaaatgtttgaagagaaaaagcagttgtcaaatacaatagtaattgaaaatgttattcaatctaagatgagaggtaaggtggtttatcaaagcagtgtagcagcaactgatgcaattaaaatgacttttattaagccttataatgatccatctggaaagggctatcaaagaccggttagtaaaaaaagatgtgttgatttttcggtgtatttatcaaaaggaaacgaggctttgttcacacctatattgataaatgcagggggggaatgggactttacaccatatgataaatcaagaacttcatttggacgtctagtatgcaagaaaaaaggttccttaatggatggtcaacacagactaggcggcattgagctatatttaaaagaaacgaatgcacaaataaatgtaccaatactagcatttcattatctagatgatgatgaggaaatcagactgtttgatacgataaatacagaagctaagggaataggttcatctctcagcaggtatttaaaaagggaatcagatgatttaagttgggtggctacccaattaattacccaagcggacagtccatttcacgaattgggaacaatcgtgggaaaaagaagtactgcaaagcatataactcttcaaaacatatacaaagcgcttacttacttaacgaagcatcctaagttgaaaaaactaaataaagagaagatacttatcatttcaatgctttatttcgaaaatatcaaaaaggtttttccggatgattggggaaactataaagaatcaaaacttactcacattgtatgtattaacgctttatcaattttaggctcaaaacttttagtaaagtgcatgattgaagatagtaaccaagtagacagctcaaaattgaataaatatcttacgaggataaacaaagtgaattggtcaaaccaaggggaaatgaaatatttaaaaggactctcaggctctaaaacacttgcaaaagatttagaagtccaaatgaatatttaagtctttgtttcaattgtagtggtaaccatggcgtatcaatttctagaactaaaaaattggtttcctatgcatgcgtgaggatatcggctttataatattactaaattcatataactaaagaattatatttcgttaagtgttttaaggtctaaagtctcttttttgtattccggaattaccgatgtatattaagtattctaatattaaatggaggcaaaacttaatgttcggtattttggaattaagtcaaaggatgacaagacttaaaattaaggcggttcacaaggtattaattggtatcgtggttctagggattggcactactacaggaacctcggtaggggctgtgggttcggattccttgcctagactgccaagccaatttcatgtacatgatgtgaatgtgccggccaattcatctgacgaaacaattcaagccgctatcaacagcgcttcaattgcaggtgggggaaccgttactttggaaaaaggaaagtatagtattaaaaaaccaatatatctaaagagaaatgtaaccattaccggagcaggtaaaggtgctacggtgctgcaaattgatgctaatttaggggctaatggtgctctaacttcgaataattcaaacccagcagtgaatgtaattatcaagaatttaacagtagatggtgtagcagcagccgaacctgataaagtactgaatcatgatgaaatcgcaaattatggtattttgctagatggcaacagctatgtgaacgataaagtactgttcgacaacattgagataaaaaacacaaacatgggactgcatatgaaagggtcttccaacgtaacggttcagaatagtgaatttcatgacaacggcgggtcaattaatttttggcataatatatacttaagaagagtgactaaagttttaatagagaattgtgatatatataaatccaattcaggaaatggcattaatatttcatattcggatcatgtaaccgttgattcatcaaaaattcacgataaccatttccgtgggattcgggtagctgtaagcagttttgtagatgtgaccaacaataatgtatatggaaataaaaccggggacggcattatatataacagtgagaagacaggtgtgaccaattttcgtattattaaaaacgctgtatcggataatggaggttatggtattaatatcaatggtgcttgctctaacggagaggttatgtccaacatcagcggagaagaaaataagaatggttacattcaaaatggaggaaaaaatgtttcagtaaaatagcaatgattcccttcactcgctaatcaaactcagcgtggcttccatgtttttggaggttgcgcttttttgttgaggggactgatataaacatggattctaatgatgaattatcttcgttttcttattacgaaaaacaaggtgatgaatacacaggctaaaagacgtgttaagaacttgaggaaaataatcgtcttggcttattaaagaaaacaccatactttgaagaagcaaaaggtaaagaaactaagttagaggagagtaaacatgtgcttgatcttcttctgtctataaaattattgtcctgcaaattcagcgcgaactttttaaagattatttagtctagttttattttagtgagtaaaaacgatagttttcacctatcatttctatacaaataattgaattgtattataagttaagctgacctatacttttattgaaaattaaacttccttagaaaccatcgaggtataaggcaatcaaaaacggaggtattttatgaaaaacttaaatgttgctattccaactccatttcatgatgatgagagtttatatttagaaggctttaattacattataggctatttaaaagaaaatgggatagattctgtacttgtatctgctactactggtgagcaaaattcaatgagcatcgaagaacgaatccagattgttaattattttaatcaagaaaaatttaaaaacgttgaacttatgtttggtgtgtcagcaacaagaaccaaagatgcaataaaactaattaaggagcttgaggattctgtctttgacgcaattctaattcagttcccaccttatattcaaccaactcaaaaacaggctattagctatattaatgagttgctacaacacacaactaaaaatgtagtactttataataatccttttagaacaggatttgagctaagtgctgaatcatttgaaactcttatcaatcaaaaacattcaaatcttgtaggacttaaagaagagagcgatgccaaacgtcattcaagtacaagcttaccaggcgactttgttatgttcgctggtggtgatataaatcttccagaaaaaatacttaaaggttgtaatgggctgtccagtatggttgggaatgtatacccaaaggagattaaacaactatttaatcaattaattttgaataaaccagttgatcttaggaaattaaaccatttaattaatgaagttacaagcggtcaagcaataatgaatataaagaatcactataactctttgggaataaaagtagggccatgtcgttctccaattaattgatctgttattaaaagagtgatttagtttttatatacttacaaaccggtaacgattttatcacttgtaatcttattatattaatgaaacacaagtgcaattgaagcagtaaacatattgcaagcaatttaaaggagtcattgcgttatacggagggtcaatattaatcatgggtaattcacaattaacaaacggaggacaatcgcggttggacttaaagcctaggataggatggcttatcataggtgtcatcctaattggtgctaatcttagagcctcactaacatcagttggtccgttagtagctacaattcgtgatgacttggggatttctaatacactagcaggagtaataaccacaatacctttacttgcttttgcatttttatccccttttgcttctaatttagctcgacgttttggtatggagttaaccctattaatttccttagtgatattaacaattgggattggaatacgttcttttgttggaaaagaaacattatttataggaactattttaataggatcatctattgccatttgcaatgttttattacctagtcttatcaaatataactttatgaaaaaaataggtatgatgacagggctttatgcagtatcaatgaatttatttggagctattggctctggtataagtattcccatttcgtcatctttgggtttaggatggtcaggagcccttggatgttggggactgttatctctgctgaccattttcatttggctaccacaactgcaatatcaaaataagtcggttcaggttgaaaaaactagggagggagttaaatctataagcttatggcgttctaagctagcatggaatgttacgttatttatggggtttcaatctttaattttctacacagtgatcacatggatacctgaaattcttgaagaaaaggggttaaatactcatgaagcaggctggacgttgtctttaatgcaacttgctatgcttcctgtaacattactcgtttctattttagctggacgtttaaaaagccagcggttattagtagctgcatctgcttctctactaatttgggggtttgttgctatcatatatggagataaacttcttatgcctttatggatgatcataattggaatcggaattggatttgcatttagtttagctatgatgttctttagtctgcgtactcaaaatgctaacgaggcagctgaactttcgggtatggctcaatctttaggatatctcctatctgctatagggcctgttttatttggatggttacacgacattacacataattggactggcccattacttatgttagtttttacttcagttattgttttaatctcgggtataggggcagcgaaaaacgaatatgtacccatcaagggatcgagtttaaaatcactataatatagtcagactataaagtagaacagcggcataattgtacctattatcccctttccaaactgtatctaaaggaggcactagatggaattaaaacaacttgaatatttctacgcagtatgtcaagaacttcattttacaagagcagctgaaaaagtaggaatttctcagccttctttaagtcaacaaattaagctattagaacatgaaattggcacccctttatttgatcgtattggtaaaaagacagcacttactgaatcaggaaagcttctcttacagtatactcgcaaaattttttatgaggtagaacaggctaagacctcaatagatgaattaaatggacttcaaagagggacaattttggttggaactttgttgacagtcgaggattacctgatcacgcctactttactgaattttcatcaaagataccctggtgtgaaggtatccgtttttgggctgcgtactggggacattcacaaacaactcatagaaaataagttggatttggggattgtattcttacctatgaaaggcgatgaattagaatcaatttctttatccacagaagaaatggcttttgcagtgcctaaaggtcacccgttagagaatcaggatatgttagatgtagaggtgttaaagacaacaccctcaattttactccctcaacattattttattaggaatcttatagatgaagcttgtaaagacttaggattctttcctaagccgatttttgaaattacaaccatgcagtctttaatcaatatggttattaaaggggtaggagtaacaatacttcctaaaccttatttagagtaccttaatcaccctcatataagaatcattccaattttaaaacctaatctttctcgtgaaattggagttgtttatagaaaagataaatatttgagtgctgcaacccatgtttttattagtgcccttaaagaaactgtatgtaagtcaaataattagtggagaatttgattgaatactggacaatctaactcatggcgattggaggggtatcatgaatagacaaatcattcatttagctgttggaaaacctaaggaatatgattggaataatcgaaaagaaatgtcagcgataggtaagtctactgtatcatctattgagctgaaaaaactcggcattgttggtgatgatgttgcgaaccacaaatttcatggcggcgttgatcgagcagtatgtttatatccatttgagcattattcttattgggaacgaatgtttaacaaaaaaatgattccgcctatttttggagaaaacattactgcaacaggcatgttggaagaacaggtttgtataggtgatgtgtatagaataggtggtaccatcattcaagtaacacaaggaagagtgccatgtgcaactatatcgaaatacaatgaagagagagattttctgaagaaagtggttgaaacatgtctaaccggttatttttttcgggtgctaaaagaaggcacgattgagtctagttcagaaatagagcttgttgaaaaggacccatgtgaaatatctgtactttctgccacacaagttctttttcatcaaaaagagaataaaaaatcaattgaagaaatattgaaaatcgatgctctcgcagaggattggcggaaaaggtttttaaaactgttataagtctctagcatgttgaaaagttggggagtttaaaaaaggactgaatcattgaatgttgttattgcaatttgcgtagattaaatgtggaattttaggagttgaaatatatgtttggaattcatgatcttcttttatttgtattgtcatcatttgtttttatagctgctcctggcatagacgctgtgtttgtattaagcagaagtatctcaaatggcagagcaagtggttttgccgcctcagctggaattgctaccggtgcttttgttcatacaatacttgctactgttggactatctattatcttagctaagtcggttgttttgtttacagctataaaaattgtgggagggctatacttaatctacatcggtattaaagcacttctcaagaaaagtgacggaataactttaaaggatacagcaaacgagacgcttaaaaaacattatattcagggggttattacaaacatagctaaccctaaaaacattctgttctatttatcatttttgccccagtttgcatcaacatcagggtcgactgtgtcattgtcatttcttattttagggagcatcttcgctgttatagctttactatggtatattttagtaacgtacttctcaactatggccacaaaaacactcaaggacaacaaaaaatttaataatattctcaataaagtctctggaacagtatttattgctcttgggtgtaagttgatggttagtcaaaaataattttttaaggagtagcataggtgtctacccttaacagccgttgtagtatatgtcataacatctccctattcaaaaatagaaatgatatatagaactaatataatatttagggagtagaggggagagaatgatgtggaaataatcgcatctattttagtagggatcgtagcattagaacatttattcattatggtccttgaaatgttttttattgattcaaatgtggcaaaacgcgcgttcaaattaccgaagcatttagaaggagatcgaaacgtagccattatgtttgcaaaccaaggtttatataatgggtttctagccgcaggccttatttggggacttataatagggtttaatccaattggctatatgattcaattatttttcgttatttgtgtggtagtagcagccgttttcggaggtttcacatccaataaatcaattattgtgaaacaaggaattccagcggttttagcattggttactcttttatctgtgatatagatccgaagctataaacgacaattttttttatgaaataaaatgagtatgtgttgttattctaaaagacatggcgtcagtgacatgtatatatctatacaatttaaaagtttatttatatgttaaaacagtgctcatttgtgcccacaatgaatataaaaaatgcaaatgagcgtaatgaatgacttctaatgctttaaatcacagtttttttgaggtctagtgggtgtattattgtccaagcaaacaccgatagtttcaaactagcggtgtttttttatttttaccatacttagtgaaagtcatctcattaggagaaacagttgttacatagcattacccaagggtgatgcattttatgaaggtaataatcatcgatggaccgcaagctaacaaatacattaacgattactgtcattatttaataaaactttataagaaggagatctagtatggtgggaatatatgtgaattcatcgactgaggaacaagtgatcaaggattgagcattgccagccagattgagggctgtattaagaaagcagggactaaggatgtgctgaagtatacaatgaaggattttctggggaatttttagaacgtccggctttcaatgcttgagggtggatgcaagcaaaggacttataagtcaaatttatcatccttcaatcgacgatgtttgtccaaattatttttgtgtaggaggggacacttaaaactgttgtaattttttttgcgagttttatagggatctgtgaaaattcccaggagcccactaccaagtccttaaggcgaaattaaagcaaaataaaccccttctgtaacagaaggggaagggtaaaactcagttaccttattttgggatcttttttaacgttttttaataaaagatgcggcatgctggttccagctggtgaatcaaaaaagcctatttgatttaagtatcataacccttttactgatctaaaacgctagtgtattatatttcgagatgtttaattaatttagctggattacccccaactacaacattatctggcacatttttagtaacaacagaaccagcagctataacaacattgttacctatcgtaactcctggattaatgactgcgcttcctccaatccatacattatttccaaaagtaatgggttttccatattctaaccctgaattgcgttctgttggatgaagtgggtgtgtagctgtatagatttgtacactagggccaagcatacaattgtcaccaaatcgcacttcacatacatctaaaatggtacaatcaaaatttgcgaaaaagttatcacctacataagtgttatatccataatcaaacctaatattgggttgcatatatacgttttttcctgacgaaccaagtaacgctttcaatacattaacccgtttaactacttcggtttctgtcgtttgattgtaaattctaacaagttgacttgctttttgtctgtcttttgctaactcggaatccgacggatcatataaatctcctgctaacattttctctttttcttttatcattaatatctccccttgttgtgttttaataatgtacgattttaaattgggtttaattttaattcctgtaggaggactttgttattcctccattagcaagagtctttattcaggatagtacagaagataagccacatatattttttgtttcagtagaacatttacataaaactactactaagagtttgtattgtgcaagagaaataatccactcttctttagtgatatgagtggattatttctaagttcttatttctcttggatctccgtcctcgtcgaaataaagtttagtacatgctgtctgcccggtgaagcgtgaattgctccttttacagaagcagtgagagctccgcttgcatttgcaaacgtcagcaagcgtcggtgatgtttacctatttgttcgcatagtgtctcctttgatatgccgattgacatcaattccgataaaaaaccgccgataaaggcatcgcctgcaccagttgtatcagaaacagcgactttaaaccctttatgttcgtacgactcgccattttttaaataaatcgccgcaccgccgcttccttttgtcagaacaacgacattaacaagtccggtgaaaagcgatgtggctgcttcttgttcatcatcaatgtttgtgataaactgcagttcctcatcggacacttttacgatatccgcaagaggcaagaagttcagaatcgtctttcggcagctatcctcatcaggccataaaggaagcctgatattgggatcaaagctaatgattccaccaattctttgaaagtcttcaataactttgatatgtgcttgtttcattggactttcaactaaatcgattgaacaaaagtgaagcatatctccttgtttaaacttttctgacattaactcattcggtgatagcagcaaatcagcggcattttttcgataaaaatgaaagcttctttccccagacttgtctacggatacaaatgccagtccggtttcaccttcatcgctttgaataatataagaagtatctacgccattttctttaagtacgccaactatataatccccgaaatgatcgttagcaatcttcgtcagcatgacggcatgcgcgccgtattttgcagcagcgattgccgcattcatcggcgcgccgccggcaacgcgctcaaaggaagtgacatctgataaagccttttctttttggactggaatgaaatcaatcagtgtttcaccgatgcaaaatatttttttcaagtgactcatcttccttccagatgtcttttaaagtccaataggtgaattcttcaagccttacagcgcctttctcagaaaacagctcaattcccaatcggccttctttcggataaatgcggcttgtcatcgttgtttccccatggttggcgaatacttcaatcgaggatctgtcaataaatatacgaagtgtcagctttccatttgcttctaacggcgcatttctcacactgtctcgagatttccccatcttagagcaatcgagtatcagcttttgatcagttatgctgtatttgatagctgtttcttcttcttcaaggcctcgaatcttcaaacctactgtttccgcaccgcaatctgttaaatcatacacgacttgaatttcaagaagctcttcggctgtttctgccaagaaatcccttgaaatcaactgtttagcacaatccatatgttttgattttcgcaacaacttagtttcttccacaggattcatcaaaattttatgatcatcccgcaatgttaattctctcggcaatgtcaaagcgccgcaccatccatctgcttttgtcggcatctcagattcccacatatccatccagcctatggcaattctgcgtcctttatcatctaataacgtttgtacagcataaaaatcatggccgtgatccagctctgtaaaatcaccatacacaaattcgtttgtttcatcattatattctccaattaaatagccagtttgatgcaaattcttatataaatcaccgtctgcctcaatgccctgcggagatatcagcaagacatgcttgccgcccaattcgaagaagtcaggacattcccacatatagccgagatctccatcactttgggcaagaacacctttgtattcccaatctcgcaaattgggcgagcagtataaaataactcgtccgacgttatctttcgttgaatttccgactaccatataccagctgttacgatgcttccatactttcggatcgcggaaatggcgggagctgtcttccggcggtttcgcgatgacagggttttcctgaagcttttcaaacacgatcccatcttgactgacagcgatattttgattttgaaagaaaatgtcattctcttgatctatcacattatgccctgtataaattaaagcaagttttccattataatctaccgcgcttcctgagaaacagccgcttttatcaaaagagtcaccaggggctaaagcgaccgggagatgttcccaatgaatgagatctttgctttttacatggccccaatgcatttgtgcccaattctcatcatacggatgatgctgataaaaaacatgatattctcctttatagtgtataagcccgtttgggtcatttatccaatttgcccgaggcataatatggtaccctaatcgataacgtgtgttcatcttttcctccgcttttttcaacgcttcctctgcctgtttgattctatccatttgtgacatcctctctatatctgtttttttgaaaaggtgaagcatatccaacgcctttcttcgaatctaataaagtgaaaattgaaataattgtgaagcacaaagccagggttcccatgaaaagataagtgtgacggaaacctatactatcgtataaaccacccgcaatcggggagaaaatcgatgtaccaacttgagatgcaaattgaaagccgacaaggtaaagaactgatgaaagacgtgtatcaaaattcgcggctaaatatttgaatatcgcaatcagcatgattggcaattctaaagcatgaataagtttcatcgatgaaattccgaacggcccgatgacaattccagacccaataatacggaaagacattaaaagccccgcgagaatcaagctttttttaggaccaagtctattaactataaagggggccagaaacaacatgcctgcctcaataaatacttgaaatgagtttaaatatccaaatatctgattccccatagccgatgtgggaaataaagaagcatagtaaatcgggaattgctgatcatagacgccgtacacgcatgtcaccccgattacgtacaacattaaaaaccaaaagtcttttaatagaaagagtcctcctacgtcttttaacctgatcgaatccgctctttccttatcataatccgtcatctcaatttttatggacataataatggccaccaatatgactgcagaaagggaagcaatccagaaattgatattaggattgatattgaacagctgtcctgcaaaaaaagttgctaccgcccagccgagtgaaccccacatccttgtcttgccgtattcgaactgatattttcggctgaccttttcaatataggtttcaatagcgccaactcccgcaagaaaagcagttcctagataaataccgccgacaatagcgccaaggaagatatcatattgtaaaagcggtccgtagataaagatataaaacggcccggtaaaaacgataagtacactaatcataaataatatgtttttcttcagcccaagtttatcagagataaagccatataaaggctgcatgcacaaagtaaagatagcgtttacagaaaagataatcccagtcgccgatccattcaatttgacttcctgtcccaaccaaatcgcaaacaaagagtagctggaagaccaggtaaaaaagaaaaagaaaagataagcgctcagtttccaatacagactttttgagcctttcatttctacagctcctttaacccaacattgatatctatttaatacctgttcctgaaccgctaagaccttccaaaatgtagcgctgagccacaatataaatcaagatcaatgggatggtggaaatcgtcaatacagccataacttgatttgtgtagacaggctctgtgctgttgatagctgtaattgcaacttgaatcggaaatttcgacttatccgttaaaaccattagcggccaaatataatcattccagctgccgataaaggctaaggttccgacagtggcgacagctggtttagacatcggtatcataatccgccagaagatttgccatgtatttgccccgtcaagcttggccgattcaatcatttcctccggaattgccatgaaaaagtttcggaacaaataaatattgaatgcccccgctaatgctggcaaaataacggcaaggcgtgtatcgaccaaaccgattttgtgaataattgtaaactgcgagattaaaatcgtttcaaacggtacaattaaaagcgccaacaaaatgccaaagagcatctttttccctgtaaaatgcagtttggcgaatgcaaaccctgccattccgttaattacaacagatccggctgctacgcacaaaccataaaaaagactgttaccaatatacataagcaattcaaaccgagtcagcacttccctataggatgaaaaccattctgccagatgaagagagggcagaaacgctttaaagctgttcatattgttgtaaatttccgcttccggtttcatggaagatgcaatcatccaaattagcggaaagataaatagaacggccagcaaaacaagacacgtatactccagaattgtcaaaggcccgaacttacgtctcaatggtcttcatcctccttaaccagcttgcgttgtgcgagtgtcaccaatccaataatcgttccaaacaagagcgcgatcgagcttgcatatccgaccatccgatcggtaaatccagtttgataaatataatagacaacggtcatcgttgaattgactggtccgccctgggtcatgaccatgggctgaacaaggagtttaaacgcgctgatcagcgttgtgataaagataaaaacagatgtcggttttaacaatggtaatgtaatgtaaataaaacgctgccatttattcataccatctaattgtgccgcctcgtagacatcctcgggaatgttttgcaaaccagctaaaaaaatgagcatctgaaaacctgctccctgccaagcggaaacgacaacgatcgtaaagattgcttgcttagggctcgtcaagaaaggctgtggtgatagaccgaagtgcgccaatacattatttatcataccttcattcggattcagcaagtacatccacaaaacggagatgacgaccagtgacatgacgacaggactaaagtatgcgactttgaaaaatgcgttggctttgcgctttttattcaataggagggcaagcccaagtgctgccccgatctgtaacggtatcaataagacaacaaattttatggtgttgcccaaactttttaagaatattgggtcctgaaaaagtttgatgaaattatcaaagccaataaacttacgcaaatcaggcgtcaacaaatagtaatctgtaaatgcgtagtacacagccatgatagaaggaatcacaagaaacattaataaaataagcaacgccggtcctaagaacataaatgcgactgcgttttcccgccagcgtattttattcactgtctttctttctattggaaaggccggcctagtctctttcaatattgttttattcatggcgtccacctgctagtttgccttatcgatggcagattgcatttcttttacacgtgtatccagcactttttgaatatcctgattttgatcataaaagctaatatcatcgattgtttgttgaaatgctcgagttacctgcggatatgccggtgtcaccggacgtgcatggcctgtttctttcagctgctgcataaagacattcatctcatcagaaaattcttttgtcagcactttttctgatgaataacgtacaggcagggcggcgattgatcggctcaattcgatattggattccttattagtcatccaatctactaattttgctgcccattctttattttcagacgcttgtgtcattgcgaactgccagcttcccgaaggagagacgagctttttggtttttggcgatacaggatacggcatcactccataatcgacgttggaaaagtttgttttcatatcggttattgtccacacgccgctcatcttcatcgggtatttctccgtttcaaacgcttgtttgacaggggtacgtgttgtatagccctctttaagcatcgtttgtataaacgtcatcgcttcaacggttggttttttgttaaagacgccatccgctttcttcccgttttctgaaagaatatccccgccagctgaccaaacaaacggtaaaagcgcataagtcaatatttcgtcttttgactgtaattgcatatcgatggctggtttatcgtatttatttttcagcttttcgcaaagctcaagaaattctttccatgtccaaggatctttcactgttggcagcgttttcaaatcaaccccggcatccttaagcatttttttgttatagtagatgcagaccgacgattcactgacgccgatggcatacagtttcccttggtaggtgccttgctgcttaatacttggcaataaatcatcctggtctttaataaactcatccaaaggtgcaataacgccagatttcgcataagccgcagtatttggtccgtccaaagtgatgacatcaggcagggtgttcgttgttagtgccgcattcactttgtcttcataacctccaccgttgccgcttcggggaatgaattcaattttcgcctcgacattttctgaagcgtactttttattaaaagcatccacccgcttttgataaacctttccttcctcattatcatccgatacgtgcacccacattgtaaccgttttctttccgctgctatttgcgctttcgcttttgttacaaccccagactgcaaacatgagcagcaacgacaaacttcctaacatcaaccttttcatattcattaatttccctccttttgcacaaaaatgtaaaagcgctttcaaaaagaattgtatgtcaaccggtttcatatgtcaaccggttgacataaatttatgcataattctaaatttaaagaacgaacttgagtatatactacgaactatggaaaatccttgcacatgtcaggctgattctctaaaataagtgcgtgacgagaattgtaagccatttcagtaaaagcagggggaaagggaatgaagcctagcattcacgatgttgcaaaattagcgggagtttcatctacaaccgtttcgagggtattaaataatcgcggctatattagcgaaaaaacaaaagataaagtttataaagcgatggaagaaatcaattactttccaaatgatttggcccgttctttatttcgaaaacgcaccaatttaatagggcttatcattccaaactccagcaatccgtttttcggcgaactcgccttttatattgaaagcatctgcacgtccatgggctataaactgctgctttgcaacagtttaaatcgaatagataaagaagaaaaatatctcgaaatgctgatcagaaatcaagtggatggtgtcatcgccgtcacctacaacaggggaatactcaattatcaccagcaaaatctgccgattgtcgcaattgaccattatttatcggaaacagttcctgtcgtcggctcagacaactttgacggaggcaaaaaggcagcagaactattgataaaaaaggactgtcagcacatcattcacatcaatgggccgattgaacttgaaacgcctgcaaatctcaggagaaaagcatatgaagatgttatgcgtgaacacggaagacagcctattacatatgaagtgtcatttcatgataactacaggaacattatttcaaaactatttgatgaacagcctgcagttgacgggatttttgccagtgatgatatcatagctgcaggagtcattacggaagcaaaaaaacgcggaaaagacattccaggtcaattaaaagtgattggttatgacggtacagaaaccattcaggctattctgccagaattgactactattcaacagccgatcgaattaatttccaaaacggccattgagattttagaaaaacaaattgaaggcaattttgatgatttaccacttgaaacatatctgcccatacagctttccgaaggtgggacaacttaaaaattgcagtagtacgtactctattatttctcacctaatcatggaagaggtgtctgttccggctcattcggaatcgtacacaatatgaaacggtaggaatagaattcctgccgttttttatttgctagggcagaggagacaatagtgaaaaatttagtactgttgtattgaggtaaacaaaattcgcttatcttcttagcttgcgggtacgtcagaaatccttgggaaaacaaactgaaatttaccaaggtagaagatttaaagtataccgggcatgggatcggttgctgcaatggaaaaaggagaaatgagaaaaagccgttatattaacggctatttagaagtgatttgtctatagaatcaaacgaggaatttatgacttagtgatagagtaacatctgggatgctttgtttatagctcgattcacaactttagatcattgaactgccttgtcaaggcgaaaagcagcgttaacttcgcctataatgttatttgaagcattagttaaattcatacttttaaatgatcttaatttttcagtttccgcgggatttaacacatcaagatcctcaagacatcttataacaatcggagctattgctctagagtaattcccatcttcaatttttattgcaataccaatgtccactcctttaattgctacacaatataccccgtcagatccaagctttccaataagttttccattagtattctttataagttcagtgcagaatccacctgtaccagctaccatctcaggtgcattattcattgctgagaaaactctctcacatgaatcttttaactctggtttcagtccatctgggcatgcaagttttgcgtaacctaatgctgcgttataaagaggaataccatgtacaggaacgccgcaaccatcaattcctataactattttttcttcctccacttcacaaaaatcagaaacaatttcttttatatctttctgtaatggatgattctgcaagttataattttctatgttataccctttagagaggcatgaagcaagcattcctgcatgttttcctgagcagtcagaatttgcagcagttaatgccacatgatttgctatctgcttaactttgtactcttcttttatggagtatttggcgccgcacagaaggttttccgtttttaatcccagtttcttaaggattctctgcaaaacatttcggtgcataacttgtccgtaatgggatgcacacataagtgatatttcttcatcgtcaaaatgatattttttatctgcaccactaaggaatatatttaaggtttggattggttttaatgatgatcgtatatatgttactttaaagggatttcctttgtaatataggagtttaccatctcttgcaactacagcaatatctcctctttgaatattttcgaccaatggacccctggttacttccaaaaggacatctgacataattcttctcctttctttttttatttgtaataattgattatgatatagataaaaaattcaatgcactctttacactatagtgtaattatttactctatagtgaacgaggtgtaacatcaattgtatcctacagagatatatcgtgcaatagctaaggaggagttatggataatttaattaatataattggcaacaatttaagtaaaatgcgtaaggagaaggggtattctttggcccaaatatctcaacttactggagtcagcaagagtatgctggctcaaattgaaaaaggacaaaaaacccccacagtaacaactctttggaaaatagctaatggtcttaatgtttctctctctttacttatggtagaccagcaaccatctgtaaaaatagtgaaatcagataactctacctacttgatagaagatgatggaaattatatgacttgtccatttattccttttgataatgaaactaaatttgaggtttataaaatggaaataaaatcagggggcgtacataagtccaatcctcattacaagggcgttaaagaatacgttttcgtttccactggaaatatagaaattgaaatagaagataaagtctacagagcttcttcgggagaagctgtggttttcccaggagatgtatatcatacttataaaaatataggggaaaccacagtatcgacgtttattttgtttttttatcccaaccgataagaaagtctaggggtcttctgtttaaatgaaaataaatcaaagtctccaacattttaacaacgtttgcactgcatcttctaattcatcttcatgaataccggcaaatccaagaatgatttttggaggactttcagactttttctcgagtgagtaattggatatcggataaattttcatgtgcgcctcagaagcctttttggtcagttcattctcactcataccattattaacaacgagaacaatgtgaagccccgagtgttcgccaatgattgagagcttatcttcatatggttttagcaattctataactttttcaagtttacggcgataaagctttcgcatcctatttagatgcctttcgaaatctccttccttcaagaattgagccagaatttgttggtcaattcttgagacagaggaggagtgatagaatgacaacttttctttatattgcttcaaaaggtgtcttggcaacaccatataactaattctgattgatggcatcaatgattttgaaaatgctcctaaataaatcactttttcagcaaggcccatgctttgtaaggaagggattgattttccgctataacgaaattcactatcatagtcatcttctataatatagcggtttttttccgctgcagcccattttaacaacttagtcctgcgatttaccgatagtacagttccatatggaaagtgatgggacggtgctatataaacaacatttatatttttatgatgaatcgtatctactcttactccttcctcatctacttcaagagtatacacttcatttggataactcttcagaattcgtaaaatcaaatggtaaccaggatcttctacaccataaatcgtttttttatctaatatgagcaaaagttgttgcaataaaatttctatgccggcgccgacaataatttgatctggtgaacaaagtactcctcttgcatgataaagataatgagcgatttcttgccgcaactctatctctccttgtgagtccccgagcaataacaaggaatgattctttttgtcgattgtatttctggcatatttgcgccatacggaaaatggaaagttctttgtatcaatagcgcttggatggaaatcgtattttatatattcctgtgcttcttctgtattttcctgtacatattgatttgtttgtacgtattctaaatcttcatacgtcataacaaaataccccctacgtggggaagcctcaatgtatccttctgctaccagttgctcatatgctgcctcaactgggttttgactaatttttaaaaaatcagctaattttcgcttagaaggtagttttgtcccgtaaggtatgcgtccttctataatttctttttttatatacaaatataattgttcatataaaggtatattacttgatctatctaaatgacatgatagcatttccatttttacagcatctccttataactgacattctgtttttaagaaaactggcactttcaatatagtcaattcctttttatactaatcaacatattctttaaatacaatagttgatggaatggagtgtaagaaatgaaaaaaacattaggtactgaaactgtaaaaagaggcatggctcaaatgcaaaaaggcggcgtcattatggatgttgttaatgcagagcaagcaagagtagctgaagcagcaggtgctgttgctgtaatggcattagaaagagttccttctgacatccgggctgcgggtggggttgcaagaatggcagatccccgtattgttgaagaagtaatgaatgcagtatccatcccagtaatggctaaagctcgaattggtcatattgtagaagcaaaagtacttgaggcgatgggcgttgattacattgacgaaagtgaagtgttgacacctgctgatgaagagttccatttattgaagagcgatttcacagtaccttttgtatgcggatgccgtgatcttggagaagctgcacgccgtattggtgaaggtgctgcaatgctacgtactaaaggtgagcctggtacaggtaacattgtggaagctgttcgccatatgcgtaaagtaactgctcaggtccgcaaaatttctgttatgagtgaagatgaattaatgactgaagcaaaagtacttggagcaccttttgaggttttaaaacaaatcaaaaaagtgggtaagctccccgttgtaaactttgctgctggaggtattgctactcctgctgatgctgcgttaatgatggagcttggcgctgatggagtgtttgttggatcaggtatttttaaatctgaaaatcctgaaaagtttgcaaatgctattgttcaagctacaacttattacactgattatgatctaatcagcaagctttcaaaagaacttggaactgcaatgaaaggaatcgacatttcaaaattgtctcttgaagaaagaatgcaggagcgaggttggtaagatggcaacaattggagttttaggactacaaggtgccgttacagagcatgtgaaacaaattgaaacattgggattagaggctgttgtcatcaagaaacctgagcaacttgaacaaatagatgggttaattcttcctggtggtgaaagtacaacgatgagaaagctcatcgaccgttacgatttctttggtccattaaaagaattttacacggctggaaaagctatctttggaacttgtgctggtatggtattagtcgctaaggagcttgttggttcagaggaatctcacttggggattatagacatttcagtaaagcgaaatgcgtttgggcgacaaattgccagctttgaagtagatcttgatataactggacttgaggatccttttaaagctgtttttatccgggctccttatattgaaagtgcggggcagaatgtagaagtgttagcaaaatatgatgggaaaattgttgcagcaagagaaggaaatgttcttacttgtgcttttcatcctgagttgactgctgatactcgttttcttcagctatttgtggaaatggttaaggagcaaaaggaagggaaagtcagttaaattgtgtaagcggccaccagtggtggttgcttttttaagtatattgttcggttgtttattattattataagggtttctttctgccttactgatattagaataaaaaatttttacttccggtggcaacttttaaatataataacatatggattgttaatttaatctaaattagagaaattttaggggttgagagatatgtttggtattcatgatttccctttgtttttaatatcagcatttgtctttatagctacgcctggtatagacgctatatttgtccttagcagaagtatctcaaacggtagaccaagtggttttgctgcatctgctggcgttgcaactggtgcacttgtacacacaatattctctactattggattgtctattatcttggcgcagtctgttattttgtttactgcaattaaaattgttggaggactatatttaatttaccttggtattaaagctcttctcaaaaaaggtgatggaataagcttaaagaatacagctaacgaaacgcttaaaaaacattatatgcaaggcgttattactaatattgctaatcctaaaaacattctgttctatttatcatttttacctcagtttgcatcaacatcaggacaatctgtatcaatggcctttctacttttaggggctaccttcgctactatagtgttgttgtggtacatgcttgtaacatacttttcaacattagccacaaaaactcttaaagataataagaaattcaactcgattctaaataaagtttcaggtatagtgtttattggacttggatgcaaattgatgcttggtaataaataattaaaaatagttaacaaaagaagctgagtattgtctttgagattgacatttcagcttcttttttaactcattctttaatattaaatacatataacttgaatttttttctcttcttcagaaaactatgctttgtggagtaagaggattctttaaataaagctagtgtagctttaaaataatgttcaactaaattaactttttgaactttgatttaaaaatcaaatatgaagagcatgttttgaaaaaagattctttaaaacatgctcttatttaatgtactcgattaacttctttataaaaaagttaaatcaatttttttaactttataaattttgttgcataaggttcagtagcttcacgactacgttttatatctatagattcatcattatattgagctttttttgtccaattataagagccacttattactgtattgagatcaattacgcaaaatttattatgcataatgtttttatacattccttgttcgggtaatcgatatgtctcaaaatgatcttcaaaacttaatccacattttctattaatatcatcatcaatgactataacttgaacatttaaaccttctttctttttttgaaccaattcctcaaatagtttttgatcggtaaaccatgctacagcaacccaaattgtatatttagctctttttatttcctcaataatttgattttgaatatcttcaaaatgggtttcaagttcgactggttcatcgtaagtatcgttacccatcacacaatatctatcttctatcttttctatgctataaccatttgatttaataattttattcagatgagcaataaatactttttcttctttatcttcaattgtatttcgatctacatcaattaacactgcattaataaatacttctataaattcttttagttttttagaattatttattctctttaatcgattaataacatactcttttctactcatattattctttcttagatcattaccaacaaaccccttactcatttcatacatatcttcaaatccaacagattcgaataattttactagctgaggaccactaaagtaaaacaattcttcccctttaccacatgctatgaaatttttaaacttatccagtgtatattccgttaaattcaaggtactacccccatttcatatcagttaaatacagctatacaaaaaattttttcatataaaaaatggaatactttattatcgcttaacaggttcttaaactacaagaaaaaccgaagccccttctttatagagataagaaattccggttcatcctttttataaacagttcaactttatttaaaatccatagctagattagtctctgtaaaacaagaaagtactttggatagtaaaaaagtatgcagatacccttttgtctttattcttcaattttacacagtaattgttgtatgatattggaaatacacgatggtgtttgtaccatcccgtttttgatccattcctctataactcctgctacacctgatacgataaatgttgtttcaaatttctcattttccgtaattgattctgctgattgtcgtatcatgctcaattcctcaatcattttcgttttgaaaaattctttgagtttgttgattgaaaggacattcaattttggatttgttaacaatgtaaaaatttcaacgttttgatatatgtattctgtagttttctctataaaggtcagcgtatttaatggatcctcactaggaaaagatgcatcataaatgcttcctagctgttcaaatatttcgtcctcgatctgctcatacaagtcaaaaacatctttgtagtgaagataaaaggtgcctcggcctatatcggcttctttagataaatcggacacagttattttgttgatttctttttcctgaagcaactctaaaaaggcatgttttatagcactttttgtcttgattgatcgtctgtcccccatagcgtcctccgttaatatacaatttatcatgtattgttcattaatgaacatgtatagctaaattgcagattgatactcaaattttcttaccattataatgaacatgtgttcatgagtcaaaaaatgtttattggaaaaggaggtgtatcaatgtttcattatcgacaagcaagagctgatgaattaaacaaagtggcaaagcttttccatgaatctttcaatcaatatccttttatggatttactcgtagaacgcgaaaaaaaagatcgttcatttatttttgaaatgcataaagtactgacaaaagcatattttaaaaagcatttctgttttgttggtattcagaatggtgaaattgttgttgctgctctattaaaacatcctgataaacctgacattagcttgatcgattatatagctgcaggtggaatggaattaatcaaaataggggtattttcagtattgaacatgttgacggtggctaatgaggctaaaacatcttacaaatccttaaaagagccggcatggtatttagaggtattaggagtttcgccatcttatcagggaaagagtttgggcagcaaaatgatcaatgactgtctaataccttttatctcaaaaagcgggggcggcaccttagcccttatcaccaatactgatctcaacagatcattttacaaaaagaacggctttgaagaatttagtgaatctcgtatcaggcgatttgatcttgaaatttataattggggttttaaaagaaaagtccttcaaacatataattagatttcctttttaatatttaaaggtgatcgtaatacttatgaaaatggaggttgaatgcatgtcttcaaaagaaaaaaagagtgtatccattttgacggaaagtcaattgtcttcgagagcatttaaagatgaagcgtatgaattttataaagaattgcgaaaatcacacccactctatccattatctttaggaaatctgggggaaggctggctcatatcgagatatgatgatgcaatacatttattaaagaatgaaaaattaaagaaaaactatgaaaatgtatttactacaaaagaagaaaagcgccctgttctattgaagaatgaagagtctttaacaaaacatatgcttaattcagatccccctgaccacaatcgtttgcgaactcttgttcagaaagcatttactcatcggatgattttgcaattggaagacaaaattcaacatatcgcagattctttattggataaagtacagcccaacaaattcatgaacctggtagacgattatgcgtttcctttgccgattatcgtgataagtgaaatgctcggcattcctctagaagatcgtcaaaaatttagagtttggtcgcaagcaattattgatttttcagatgcccctgaaagacttcaggagaataatcaattgttaggggaatttgttgcataccttgattacttagttcgtaaaaaaaggagcgaacctgcaggagatttaatcagtgcattaattcaagtggaaagtgaaggcatacaattaagtacagatgaattgtactcgatgattatgctgcttatcgttgcaggtcatgaaacaaccgtaaacttaatcaccaatatgacatatgctctgatgtgttatcaagatcaattagaaaagctccgtcagcagccggatttgatgaattcagccatagaagaagcattgcggtttcatagcccggttgagttaacgactattcgatggacggctgaaccgtttatactgcatggacaggagattaaacggaaagatgtgatcatcatttccttagcatcagcaaatcgcgatgaaaagatatttccaaatgccgatatatttgatattgaaagaaagaacaaccgccatattgcttttggccatggaagccatttttgccttggtgcacagttagcccgcttagaagcaaagatagcgatttccaccttattacgccgctgtccaaatatacagttaaaaggcgaaaaggaacaaatgaaatggaaagggaattttctgatgagagcactcgaagaactgccgcttagtttttaattttttgagggacaagtgattttcaaacatatttcgtttttactccccaataacttaattattttaaatgctgaatcaacataaaaaaatattacatgatagagcttttcaaaaacaaagtttaggatttatttaagcttactgggagtgaaaatgtcttgcaaacaccaatggtttcatactatcggtgttttttttattgtttttcaacctcatttaaattctcctcatttggacaaacagctgttacataaccttacccaagggtgatgcattttatgaaggaaaaatcatcgagagagtacaagctgacaaatgcattaacgatggcaatcattatttaataaaactttataggaaggagatccagggtgatagcaatatgtgtaaggtatcaacagaggaacaagtgaacaggcctgtaaagaaaaggatgtcttgagatatgcagatgaaggattttcaaacgagcattaaaaagccctttgagtcgcttgaaagaggacaacttttatataattatgtcactaaatattataagggatgaagatgaaatgaggtcggctctcttcaaccatttggatgaacaaatttcttataattgattaatagaactatatgttatggtttacaaatggttaaaactaattgacaacagaattgatgaacagttcatggacattacaggcagccagaagctgtttgggacgccgatggagatcgcgaaaagcattcagggcagaatcatgcgggagatcggcgtttatgcacgggtcggaatcggccctaacaaagcgctggccaaaattgcgtgtgacaattttgccaaaaagaatacgaacggtatttttactttaacgaaagaaaatatgaaaaccgaaatgtggccgctcccggtgggcagcatgtttggcgtcgggagccgcatgaagcatcatttaaatcgaatgggcatcagcacgatcggcgggctcgcggcttttccgctcgatcttttaaaaaagaaatggggcattaacggccacgtgctgtggatgacggcaaacggaatcgactattcccctgtgtcaacttcgtctctggacgggcaaaaggcgataggccatggaatgactctcccgagagactacgaacactttgacaaagaaatcaaggtcgtattgcttgagctgagtgaagaagtgtgcaggcgaagccgaaacgccggggtcatggggcagacggtgtcagtgagctgccggggtgctgattttgattggccgacgggcttcaaccggcaagtgaagctggcagagccgactaattctactcaggatgtatatgaggctgtacgccggctgtttcttacattttgggacgggaaacctgtccgccgcctcggtgtcaatctgtctcagctctcatctgatgacatatggcagctcaatttatttcaggattatgcaaagaaaatgagcctaggctatgtgatggacggcattaaaaatcgattcggcgacacagcaatcatcagggcggcgtcactgacagcggcaggccaggcatttgaacgtgcggctaaaataggggggcattataaatgaacgatcatttaaaaaggggcaacctgctgtgggaagggagcaggatgtttctgccggaacataagcaaagcctgctggagagaaagcggcttaaacagaagctgcaaaagccgatccttgaccccgataagctggaagagatgaatcaaacgctttgcgccgcgatggagttcgctcaggatatcactgtcagctgctttcaggacggtgagattgtccgctgcaccgggaagatctgccggtatgaagagtttgaaaaagcagtatggataaaaggagacgaggatcagctttataagctgagacttgatcaagtgcttgatattgtgctgtaaagtctctcctcctgcttgggggagaaataggctaaaatgatgaaacattgttccctcggcagtctggaaacgtatgataaaggaaagaaggcatttacaattccagccaggcaaaatataatttttatattgtgagaaaaagagctgacattcgttttgccagacggagggagatcaaatcgtaatggatattcgaacaatcacgtcttcagattatgaaatggtaacgtctgtactgaatgaatggtggggcggcagacagctgaaagaaaaattgccgagactattttttgagcattttcaggacacaagctttattacatccgaagataacagcatgacgggatttttaatcggatttcaatcgcaatcggatcctgaaacggcgtacattcatttttccggtgtgcatccagatttcagaaaaatgcaaattgggaaacaattgtatgatgtatttatcgaaacagtaaaacaaagaggctgcacccgggtaaagtgcgtcacttcacctgtgaataaggtatcaatcgcatatcacacaaaattggggtttgatattgaaaagggcaccaagacggtaaatggcatctcagtgtttgcaaactatgatggcccaggccaagacagggtactgtttgtcaaaaacatatgagggggaaatatgatgaattttttatcaaaaacacctgagcctccttactatgcagtcattttttcttctgtcaaaagcgaaaatgacacaggatatggagaaacagcggagcggatggtatcgcttgcggcggatcagcctggatttttaggcgtggaaagcgtacgtgaagcggatggaaggggcatcacagtttcctattgggacagtatgaacgcaattaaccattggaagcatcacactgaacatcaagcagcaaaagaaaaaggaaaaagcgtttggtacgagtcgtatgcagtccgcgtcgcaaaaatcgaaagacagcggctgtttcaggagaacacgaatgattgaatttctccagcataaggaagacactatagcgcgtgagattttagccgtacagatccccgcctacataaaggaaacagagattatcggttttgacggtattcccgctttacaagagaaggtgaaggatattcaagcatcccatgagcggtttgcgggatatcggaaaaacggcaagctgatcggtgtcatttcatatgagaaaaacatgcatcatctcaccatttgcaggcttgttgtgcatcctgacggtttcagaaaaggaattggacgagcgcttctgcaatttgtcattgatcataatgaagacgctgagaaaatcgaagtagtcacagccgagaacaataccccggccgtgtcactctatacacaggctggattccaaaaggaagaaaccgtcaaagcagcgcagggtctattgctgtcggtctttcatttgtatccgaaaagaaaagttgaggtcattctctacaacgaaaaatgggcagaatgtttcgatgaagaaaaagaacggctgaagctggtgttcgggccggagattatcgctgttcatcacatcggaagcacatcaataccgaacatggcagcgaagccaatcattgatatgttaattgaagtcagaagcattgaagccgtgagccaatttgatgaacaaatgaaggctaacggctatacaccaaaaggtgagaacggcatagcgggcaggcgttatttccaaaagggcggaaataaacgcactcatcatgtccatatgtacgaacagggaaaccctgctattgaaaggcatctgttattcagagattatctcagagctcatccaaacatagcgaaagaatacgccgttctcaaaaaatggctggcggcccagcatcctgacagcatcaatcagtacatacaagggaaagatgagtggatcaagactgcagaagaaaatgcgaagcggtggaaaaaaggcagaaacaatgcgaatggcagtgttgtatgctacaatagcgaaaatgatgaaaacgggggtttcaccttatgaacatacatgtgacagatgcagcaaaacaggcactgcagcaggcgtttgacgccaacccggggaaaaaagcccagcttcgttacgatgcagaaggatgcggctgcgcggtaagcggtgtcccgacaatctggctggcagaagaattaacgggacagtgcgagcagctggaaacgaacggcattccgctgtatatccaatcgtcacaaaaagtgttttttgacgatcaaatgacgatcgattacaatgaaaaagccaaaacattggcgctgaaaagcccggctgaaatgctcagccccagaatgagcatattagtaaagtaggagacgcgaaacgtggaacaaaagctgaaggcaatgaagaacacagcacaaaataaaacgtgggtatccttcctgaatcaaaaccatccctataccttgcttcactggtcaatcggaggagcagagtccatcaagaaagatgtctggctattgcaggatgaaatgacctttgagacgcaggagtttacaacgatagatcttgcgattgaatggatcagagaaaatatggatggcattaccgacgttctgtaacataaaaaagcggaagagccgaataggcctttcgcttttttattctgttgaatcattcatgttgtctaaaaactcctgcactgtttttcggtacgtatcccgatttttggtatatgacatggcgtgttcaccgttctcggcaatgtacagcgctttcggcccgcgtttcttttcataaagccgctcggttgaagaaacaggaatgtagtcatcatccttactgtgaataaagaggaccggcttttcgattttatcaatgacagcaagcggagatacttcacgtgcgcgatagccgcctctcagcttcaaaaagaagtcggcgataggaagcaggggccaagacgggagcctgtattccgctctcagccgataggcaagctgttcatcaaaacatgcgaacggacaatcggcaatataaaaatcagcgccatcgctgcagtgtgcaccagcataaagcagggcggtcacagcccccatcgactcaccatgaattccgatcagtccgcgatgatttgttttgtttttgagccagctgacaaccttattgagatcatccttttcgtaaaacccgtagctggtcgtctttccgccgctttggccatgtcggcggtggtcataaatgagcacattccagccgagatcaagaaataaatgcatatacttaagagaattcagcacattcatggttaccccgtggcagatgatgatagtgttaggtgtgtcatgcggtgcgacatggtatccttttatgtcatacccgtaagcggagggtatcacaaaagcggttttctccatttgctcaaatgattcaaacacatcatgtccgttgtctgtctctcttttgataatgtcttcatccgtttttttcttgatgaatagaatcatatttgaaaaaacaattccgattgcgatgacagctgttacgagagcgccaatggccaaaaggattttcttcaaaagtcacagcacctttcaactaaatataggtaattcgtgtttaaaatcattatacctaaacactgctccgctgagaaagtgatcagaagagagtctgcttgttcagtgtatatgctccgtgataaactgtcttcaaaacaaaacatgggggaagtctgaatgaaaaaacaaaaatccgctgataagcaccagctaaaagacggccttcaatccgatatcaaagcaaagcttatggagatgaagagccaattgaaggaagaggatgaaaagaggcaggaaagagaaaaagcagaacagatcagaaagaaaaaagagatcgaaaaaaataagagctttgaagaactcctaaatgaaagccaaatggattggcatcaatataaataaaccagcacccgtacaggtgctggtttttctgctatgagcgatgagctttgtaaatgacttgtttcgtatgagattggagcgctttgatttcctcttcggttaaacgccgtgcatttgctgcctgaatattttcccgtaactgctcaatcttactggcgcctgtaatcactgaagcgacagccggctgtgctagcagatactgcagcgacttttctgtcatggaaagatcgggagccacttcctccattgccttgcgtgcatttgtcagttcctcgaatgaataggacaagtacccgttttgtttcatactgtctgaagcttgatcaagcggtttttcagttaagagccctttggcaacaggacctctggcgactacgctgatttgatgttcctctaaaagcgggagccattcctcagggcgtctgtcaaacaggctgaattgcatcataatgctgacgatgtttgatttttttacatattctttaatcacattcgggcggatggaagaaatgccgtagtagcggatgacaccttcttgttttaattcctcaaacgcttcgatcgtttcatcaatgttgtcctctatcgtgccgccgtgaagctgataaaggtcgatataatctgttttcagacgtgtaaggctcttttttaccgcctcttttatgtaagcttttgaagggtcccaataccagccctcgcttccgtcatcccaacggtttcccgcttttgttgccagtataatatcctggcgtctgttttggatcgcatcaccgacaatttcttcgttgcgtccccggtcatacaaatccgctgtatccaaatagttgatgccaagctcgatcgcttcatccagaatggacaaagcttggtttttttcagttccaagagacatacagccgagtccgacttcactaatgtctaaatcagatgtacccaatttgcgctttctcatgtgcacactccttttttaggctttgtattgaccgtaatataaaggagctaaagtttcaacttttatggctttgagatccaatctttcacatgttgaaatgtgcgtccatactcttttaacttcgcccgaatttcccatgcttttccgactaagacaacaccttttggcatgcggtgcactttcacgaagaagcccccttttgctctagtatgataaaatgtatggggcatcatatagagacagaacgggagatgaagaaatgaaatcattagaagaaaaaacaattgccaaagaacagatcttttcgggtaaagtcattgatctttatgtcgaggatgtagagctgccaaacggcaaagccagtaaacgtgaaattgtgaaacaccctggagctgtagcggtactagccgtcacagatgaagggaaaatcatcatggtcaaacaattccgtaagccgcttgagcggacgatcgttgaaattccggccggtaagcttgaaaaaggtgaggagccggagtatacggcacttcgggaacttgaagaggaaaccggttatacagcaaaaaaactgacaaaaataactgcgttttatacatcacccggatttgcagatgaaatcgttcacgtttttcttgctgaggagctttctgtgcttgaagaaaaacgggagcttgatgaggacgagtttgttgaagtgatggaggtgacgcttgaagatgcgctagagttggttgaatcgcgtgaagtatacgatgctaaaacagcctacgcgattcagtatcttcagctgaaagaagcgctccaagcacaaaaatgaaaaagatttacgcggatttgcacattcatatcggccggacctttacaggaagggctgtcaaaataacaggcgccaaaacattaacactggacagaattttggttgaggccagtgaacataaaggaattgaactcctcggcattatcgactgtcattctccggaagtcattctagagcttgaggaaggcatttcatctggaaaatatcgcgagcttgacgggggaggaatccgttatcgcagcacgactcttttattggggagcgagctggagatttatgatgaagcctgtagcggaccgatccatgtgctcgtatttatgccgacgctggctgatatgaaacagttttcaaactggctgtcagcccggctgaaaaatattcatttaagctcgcagcggatttatgaaacgggcttaaagctgcaaaaaaaagtgcaggatatgggcggcctgtttatccccgctcatatctttacgccgcataaaagcttatatggaaaaggggttaaatcaagcttaactgaggtttttgatccatctatgatagacgcggtggagcttggattaagctgtgatacagacatggcgtcacacgtatcgcaattgaatccgtatccttttttaacaaattctgatgcgcattcgttggggaaaatcggcagagaatataatgaactatatgtgcagtcagctgattttactgaatttgctcttgcattaaagggacaagatgacaggaaaattatcgcaaattacggcttggacccgttattggggaaatattatcagacggcttgcgaagcgtgcggagagcctgctgtaagcggggaaacagcgtgcgtgaattgcggaaatgccagatttaccaagggagtcagcgaaagattgcatgaattgagtgatcagcttgaagttcgcgtcccgcgtccgcgatatgtacatcagatcccgctgcaatttgttccgggtgtaggcccgaaaacgctggacaaactaaaaaaagccttcggaacagaaatggctgttcttcatgaggctgcagaagaagatttggctcgcgttgtcccgccgaaaaccgcggcgcttatcgtaaaagcgagatccggaaaattggaattgaaagccggaggaggaggaacctacggtaaaattaaaccgtgagctaaagattaactcagttcctcctgtacttttctttttgtgcgtataaaggtaatcagctggatgatttcatcttcactcagcggctggccatcaacagaaatggtaaagtcaaggctgctccacgtggccaattctatggcctgaggagcagtctgcttttgtttctcgcggcctaaaagttcatcgcaggttgtgtcaaagaggtcagccagcatggcaagcgcttcaagtgaaggccgtcggtagcctgactcgtagccggcatatgtgctttttgcgataccgagaaggtcagctgtatattgaagcgaccaatttttcttttttctcaattcagttaaacgatctagattcatgaacttccgctcctttttcaccttgagctgattatatcatataggtattaggaagtgtacgcgaattgaataataatgtcttgcgtattttattttccgtgtctataattgcattaaaagtatgcgaaaagcgaataccttctcgcaacccatctttagatacagtgaagaggtgcatggtatgaaaaaattattgatgttgacaactgggggaacgattgcttcagttgaaggggaaaatgggctggctcccggagtcaaggctgatgaattattaagttacgtatcaaaacttgataacgattacacaatggaaactcagtcgcttatgaatatagacagcaccaatatgcagcctgaatactgggtggaaatagcggaagccgttaaggaaaattatgatgcctatgacgggtttgttattactcacggtacagatacaatggcctatacatctgccgcactatcgtatatgctgcagcatgccaaaaagccgattgtcatcaccggctcgcagattccgatcacgttccaaaaaaccgatgccaaaaaaaatattactgatgccattcgatttgcctgtgaaggcgtgggcggcgtttatgttgtgtttgacggcagagtcattcagggaacacgtgcgatcaaattaagaacgaaaagctacgacgcatttgaaagcatcaattacccatatatcgcttttatcaatgaagacgggatcgaatacaacaaacaagtaacggaacctgagaacgacaccttcacagttgacacttcactatgcacagatgtatgtctgctgaagctgcatccaggcttaaagcccgaaatgtttgatgccctgaaaagcatgtacaaaggaattgtcattgagagttatggcagcggaggggtgccgtttgaaggcagagacattttgtcaaaagtgaatgaactgatcgaaagcggcattgtcgtcgtcattacgactcaatgtcttgaagaaggcgaagacatgagcatttacgaggttggccgcagagtcaaccaagacttaattatccgatcaagaaatatgaacacagaagccattgtgccaaaattgatgtgggcgctaggtcagtcttcggatcttcctgtcgtcaagagaattatggaaacgccgatagctgatgacgttgtcctgtaaaatgtaaaaacgataaccagcaaagagaaagaaggttaaagattatgttaaacggccaaaaagaatatcgcgtggaaaaagacttccttggggaaaaacaaattgaagcagatgtttattacggaattcagacgctccgtgcttctgaaaatttcccgatcacaggatacaaaatccatgaggaaatgattaacgcactggcgattgtgaaaaaagctgcggctcttgccaacatggacgtgaaacggctgtatgaaggaattggccaagctatcgtacaagccgctgacgagattctggaaggcaagtggcacgatcagtttatcgtcgatccgattcagggcggtgccggaacttctatgaacatgaacgcgaatgaggttatcggaaaccgggcgcttgaaatcatgggacataaaaagggagattatatccatttaagtccaaacacacatgtgaacatgtcacagtctacgaacgatgtgttcccgactgctattcatatttccacattgaagctcttggaaaaactgctgaaaacaatggaagatatgcatagtgtgtttaagcaaaaagcacaggagtttgactctgttattaaaatgggccggacacaccttcaagatgcggttccgatccgtcttggccaggaattcgaagcttacagccgtgttctcgagcgagatatcaaacgaatcaagcaatcgcgccagcacctgtatgaagtcaacatgggcgcaactgctgttggtacagggctgaacgctgatcctgaatatatcaaacaggtagtaaagcaccttgctgatattagcgggcttcctcttgtcggcgctgatcatcttgttgatgcgacacaaaatacagatgcctatacagaggtatcagcttcattaaaagtctgcatgatgaacatgtctaagatcgcaaacgacctgcgcttaatggcgtcgggaccgcgcgccggacttgcggaaatttctctgcctgcacgtcagccgggctcatctattatgccggggaaagtcaatccggttatggcggagctgatcaaccaaattgcgttccaggttatcggaaacgacaatacaatctgccttgcttcagaagccggccagcttgagttgaacgtcatggagcccgtgcttgtctttaatttgcttcaatccatcagcatcatgaacaacggcttccgttcgttcactgacaactgcttaaaaggcattgaagccaacgaaaagcggttgaagcaatacgtagaaaaaagcgcaggcgtgatcacagctgtcaatccgcatcttggatatgaagcggctgccagaattgccagggaagcgattatgacaggccaatcagtccgtgacctttgcctgcagcatgatgtgctgacagaagaagaattggatattattttaaacccatatgagatgaccaaaccaggtatcgcagggaaagaactattagaaaaataaaatttgtataaaatacagcttattcatctccgaatagtcggatgaataagctgtttacaacatagggatgaggaagtatagtatacgtgttgcactatatattgaaagcgttttagcttttacatgaagggggacttcttttgaaggatgtaagattgccaacactatttgaaattattattgtactaggagtatttttagcacttgttctatcgtttacagtctttctcgacttgccgatacagctggcgctttttgtttcatggtttattgcaatgcttttaggtataagactcggttattcttataaagatttacaaaatgcgattgtacatgggatatcaaatggccttgaagccgtactgattctcgtttcagttggggcgctcatcggaacatggattgccggaggcgttgtgccgactttgatttattacggactggaatttattcacccaagtatctttttactggcaacgttaattatttgttccattatgtctgtggcaacaggaacgtcatggggaacagtcggaactgctggcattgccatgatcgcaattggagagggtttaggcattccgcttcctctagtagcgggagctattctttcaggtgcttattttggggacaagctgtctccgctgtctgacagtacagttctagcttcttcactatcaaaagtcgatgtattggctcacgtgagagcaatgctttatttatcaatacctgcttatgtcattacagctatactctttacagttgttggatttatgtacggcgggaaaaatattgatcttgataaagttgaattcttaaaatcatctttgcaaaacacgtttgacattcatatttggatgctgatcccggcagttctcgtcatagtcttattggcgatgaaaaagccatctatgccggttatcgtaattggcgctttactcggtgcaatctgggctgttgttttccaaggaacggatattgcccgtgcgattgcaactgcgtacaacggcttctctattaaaactgatgttgaatttttgaacggcttgttaaaccgcggtggaattgtcggtatgcttgattctctcgtcgtcatcatctttggccttggttttggcggtctgcttgagaaactcggcgtgttaaaagtcattgtttcaacgtttgaaaagaaattaacttcagccggcaatgtcacattgtctacactgatcgtagcgtttttagcaaacatcttcggctgtgcgatgtatgtatctcttattttgactccgaaaattatggaagacagctatgatcgcttacatctggatagaagagtgttatcacgtaactcagaggtcgggggaacattgacttcggggatggttccttggtctgataatgggatttacatggctggtattttaggtgtttctaccttctcttatctgccgtttatgtggctcagttttgtagcaataggtcttgcaattatctatggttatacaggaaaatttatatggtatacgaaaaacaatacagttaaagccgaaaaactaggctaataggggaggatcactgaatgatagcgaaacacatgattcggacactgatgatcgaaacgccttcggttcccggaaatcttggaagggtggctacggcaatcggccttctgggcggagatattggtgaagtggagacggtaaaagtcggacccaattacacaatgcggaatattaccgttcaagtggagaatgaagaacagcttcaggaagtgatcgcggctgtacaggccctcggagaagggatcaggcttcacaccgtatctgatgaagtcctgtccgcacatgaaggcggaaaaatccaaatgaaaagcaaaatgccgatccgttcactggcagagctgggacgtgtctatacaccaggtgttgcagacgtgtgccgactgatcgaaaaagaacctgaaaaagcttctatttatacaacgatcagcaattctgttgcaattgtaacggatggaaccgcaattttaggccttgggaatatcggctctgtggctggcatgcctgtcatggaaggaaaggctgctttgtttgatcagctggcgggtattagcggcattccgatactgcttgatacgagtgatcctgaagaaatcatcaaaacagtaaaacatatttctccgggctttagcggcatccttcttgaggatatcggttcgccgcattgttttgaaatcgaggatcgcctaaaagaggagctgaacatccctgttatgcacgatgaccagcatggtacagctgtagtgacgctggcagctgccatttcggcatgcaggagtgcgggggttgacctgaaggaagcgaaagtggggcaaatcggccttggtgcagcaggcgtggccatctgccggatgttcatggcttatggtgtgaatgctgtgtacggaacagataaatcagagtcagcaatgaaccgtctcgaacaatacggcggacaggcagtttccagtattgaggagctcatggaaacatgtgatattgtcattgctacaacgggcgttccgggtttaataaaaccggcatttgtacgttctggtcaagtaattttggctttatcgaatccgaagccggaaattgaaccggaggccgcgctgcaggctggcgccgcatatgcagctgacgggcgttctgttaataatgtactcggttttccggggatttttagaggagcgcttaacgcaaaaagcacggagattaatcatgatatgcttgtcgcagcagcagaggccatcgcagcttgcactaaacaaggtgatgttgtccctcagccgcttgattcaaaagtccatcatgcggtagcagcagctgtcgagcatgcagctcttacagcagtgaaataaatgtagctaaacagcacctgtcgtagcaggtgctgttttttttcttatcattgttcaattttgttatcattactatgaaaataaaaaagggagtgatcacatggcaaaaagccaagcgaaaaagaagcgggggcatcgattgagaaacggcggacgtgacgtcttattatcaagaggcagcacaccatctttcagcacacatgaaagaatgacaaaaagcaaaaaagagattttgaataaacggaagcataagaatccttatgatcatacagcagttgatgataaggatttttttgtgccccaaaaagccgcctagcattcgtctctatcgtttctttttgaaaaagggcatgtttttctgtttctttcatacaatctattaaatcaaatcactagagcgggcgggaggaaacggtatgcgaaaaatctcttataaggacatgtttctcaggcatgttaaagatcatctctctctttatatatttgtgtcagtgctgtttttcatgggtgtcatctttggcgcgattattgtcaacagtatgaccatcagccagaaagaagatttatactactacttaagtcaattttttggacagctttcggatggaaaacaggcaagttcagctgatatgtttgggcaaagtatctttcataatgcaaagtatttaggcctgatgtggatactcggaatttccgtcattgggatgccgattattttcatcatgatctttctgaaagggatcgtcgtcggctttactgtcgggttcctagtcaatcagatgggagtaagcgggtttttcctatcatttgtctccgttttgccgcaaaatgtgctgctgattccggcttatctcattatgggcacatgtgcaattgcgttttctttaaagttaatcagacagctgttcgtgaaacgaagcctgcatgacgcgccgattcaatggttcgggcggtatgcctttgtgctgctggtcattctgtttttagcgctgatctcatctctgtttgaagcatacttatctcctgttttaatggaaaagcttacatctagacttttttaaaatcattattaaaagaaaaccattttatttatcagtttataataattatagttggaactctgcgcgtattttgttataatgagtcatggaatgcggcgtaggagggaaagacatggaaaaccgtattgatcgtattaagaaacaactgcactcatccagctataaacttacgccacagcgtgaagcgacagtaagagtgctgcttgaaaacgaagaagaccatttaagcgcagaagatgtatacctcctcgtaaaagagaaatctcctgagatcggtctcgctacagtataccgtacgcttgaattattaactgaattaaaagtcgtagataaaattaactttggagacggtgtgtcccgttacgaccttcggaaagagggagcagctcactttcatcaccacttggtgtgcatggagtgcggagccgttgatgaaattgaagaagatttgcttgaagacgtggaagaaatcattgaacgtgattggaaatttaagattaaagatcatagattgacgtttcacggcatttgccaccgctgtaacggaaaagaaactgaatagacggtgccgagcgcgaaccttttctcatagggaaagggttttttgctgtttctatgtataaaacctttctgatttggcatatggtttatataactggaaccatagggaaaggatcgattaggacatgggaagattcctgaaaacagctgtcgatgcattgaaagttttcatcctgtttaccggttttaccgctttgttctattatgctatgatatgggtgaatcaagagtatgaaaactatcatcggtatgataaaccggaaggctccgctgtaaaagttgttgaaatggatcaggatgaaaaaggcggatggctcgaccggttgatctttttttaccaaaacggggagtagatcaagagtgaaagatcaaataaaggatttcatccactacgtcatggtagagagagggctctctcaaaatacgatcgtatcctatgaacgtgacttgaaaagctattctctctacttaacagaaacccttcatgtgacggattggaatcacgttacccgcatacatattatccaatacttaaagcatttgaaggactcggggaaatccggcaagacatcggcgcggcatttggcatccattcgctcttttcatcaatttctgctcagggaaaaagtaacggataaggacccttccgttcatatcgaaacacaaaagacggaacgggcgcttccgaaggtgctcgcgctcaatgaagtcgagcggttattggacacgcctaagctgacgagccctttcggatatcgggataaagcaatgctggagctgctttatgcgacaggcatacgagtcagtgaaatgattgaattgaaaacggctgatgttcatttatctatggggtttatccgatgcttcggcaaaggaagaaaagaacggattgtgccaatcggtgaagccgctgcttccgccattgaggaatatatgacaaaagccaggggaaaactgttaaaaaataatgtatctgacgccctctttttaaatcatcacggcaaacagatcagccgccagggattttggaagaacctgaaaaaaatcgcattggaagccggcattaagaaagagctgactccgcatacactcaggcattcctttgcgacgcatctgcttgagaacggggcagatttaagagcggtgcaggaaatgctcggtcatgcggatatatccacgacgcaaatttatacgcatgtgacgaaaacaaggctgaaggatgtgtacaagcagtttcatccgcgagcatagccgcaggtggctgcggcttttttgtttagagcgacagaaaatattgaagtttctcattatttccaaatacattgtcaacgggaatgaaaacggtttatacttgagttgtcagacctcttagcgatacaatagacgtatagaaaaaaaggaggctttcaagatgcctgcatacaaatataatcgtgtgtttttaattgtgatggactcagtcggaatcggcgaagcgcctgatgccgctgactttaatgacgaaggcgctcatacgctcggtcatattgccgagcatatgaacggattacatatgccgaatatggcaaagctcggccttggtcttatcgaagatatcaaaggtgtagaaaaaacagaacatccgcttgcctattatggaaaaatgcaagaagcgtcaaacggaaaagatacgatgaccggccattgggagattatgggtttatacattgataaaccatttaaagtgttcccggaaggctttcctgatgaattgcttcaagagctggaaaagagatctggccgcaaaattattggaaacaagccggcttccggcacagcgattttggatgagcttggtcaggagcacatggagacaggggctttaattgtttacacgtctgctgactctgttctgcaaattgccgctcacgaagaggttgtgccgcttgaggagctgtatcgcatttgcgaaacggcgagagagctgacgcttgatccgaaatatatggttggccgcattattgcacggccgttcgtcggagagccgggtcaattcaaacggacgccaaaccgccatgattatgcgctgaagccgtttgatcgcactgtcatgaatgaattgaaagacagcggcttagatgtgatttcaatcggaaaaatctctgatatttacgacggagaaggcattacttcttcacgcagaacggtttccaatatggacggaatggacaaggtgatcgatacgctgggagaagactttacgggtctgagctttgcgaaccttgttgattttgacgcgttattcggacaccgccgtgaccctgaaggctacggacgcgcgcttgaagaatttgatgcgcggcttccggaagtgtttgaaaaaatgagagaagacgatctgttaattattacagccgaccatggcaatgatccgattcatcatgggactgaccatacacgcgagtatgtgccgattctcgcttacagcaaaaaacataagaaagcgcaaatgctgccgcttgcagatacatttgctgatatcggcgcaacgatcgctgataatttccaaacgaataaaccgaaatacgggaaaagctttttatctttattacaatagggggactgtttcttgaaggacagaattgaacgcgcagcagcttttattaaacaaaacctgccggaatctccgaagatcggccttattttaggctcaggtcttggcattttggctgacgaaatcgaaaatccggtcaagctgaaatatgaagacatacctgaattcccggtatctactgttgaagggcatgccggacagcttgtgcttggcactcttgaaggagtttccgtcattgcaatgcagggccgctttcatttttatgaaggctactcaatggagaaagtcacattccctgtacgcgtgatgaaagcgctcggtgtggaagcgttgatcgtgacaaatgccgcaggcggtgtcaacactgaattccgtgcgggagacttaatgattattaccgatcatatcaactttatgggaacaaacccgttaatcgggccaaacgaagcagatttcggcgccagatttccagatatgtcttcagcctatgacaaagatctgtccagcctggctgaaaagattgcgaaagaccttaatatcccaattcaaaaaggcgtgtacactgctgtgacaggaccttcttacgaaacaccggcagaagtccgtttcttaagaacgatgggctctgatgcagtcggcatgtctactgttccggaagtcattgtggcgaatcatgcgggaatgcgggttcttggcatttcctgcatctctaacgcggcagccggaattctggatcagcctttaagtcacgatgaagttatggaagtgaccgaaaaagtaaaagctggattcttgaagcttgttaaagcgatcgtcgctcagtacgaataaatatgaatcaatgcaggaccaaaagacagctgtgtctgatatcacacagctgtcttttttcatgcccaaaattcgaaacattttccatcagtggcgtataaaaccatcccgcttggaaaaaataaaaaggattatgaaatggagggcttttgagatgaaacgtcttttatccactttgttgattggtataatgctgcttacatttgcaccgtctgcatttgcaaaacaagacggaaaacgtacatcggagcttgctcatgaagcgaagtctgcggtgctgatagaacgtgacacaggaaaagtgctttacaacaagaacagcaatgagagactggcgcctgcaagcatgacgaaaattatgacgatgcttttgattatggaagctttagataaaggcaaaatcaaaatgagtgataaggtccgtacaagcgagcatgcggcgtcaatgggcggctcacagatattccttgagcccggcgaagaaatgactgtcaaagaaatgctgaaaggcatcgcaatcgcttcgggaaatgacgcttctgtagccatggctgaatttatttccggctctgaagaagaatttgttcagaaaatgaacaaaaaagcaaaagagctgggattgaaaaatacatccttcaaaaacccgaccggattgaccgaggaaggacattacagctctgcttatgacatggcaatcatggctaaggaattattgaaatacgaatcaattacgaagtttaccggcacgtatgaagattaccttcgtgaaaatacagataaaaagttttggcttgtaaatacaaatcgccttatcaaattttatcctggtgtagacggcgtaaaaacaggctatacaggcgaagcgaaatattgtctgactgcttcggctaaaaaaggaaacatgcgggccatagcggttgtattcggagcgagcacgcctaaagaaagaaacgcgcaagtgacaaaaatgcttgacttcgcctttagccaatatgaaacgcatcctttatataaacgaaatcaaacagtagcaaaagtaaaggtcaaaaaagggaaacaaaaatttatcgaactcactacatctgagccgatttcaatattgacgaaaaaaggcgaggatatgaacgatgtgaaaaaagaaatcaagatgaaggacaatattagtgctccgattcaaaaaggccaagagcttggcactcttgttctgaaaaaggatggagaagtactcgctgaaagtcctgttgctgcaaaagaagatatgaagaaagccgggtttatcacattcttaaagcggacgatgggagactggacaaaatttaagtaattatgccgaatgaccactagttttgtcacggtgaaggaattcattccgtcgaaatcgaaacactcattatccgatcatatcaaggaggaatgagcatgagccttggaattgacatgaatgtcaaagaatctgtgctttgtattcgattaacaggcgaactcgatcaccatacggctgaaaccctgaagcaaaaagtgactcaatcattggagaaggatgatattcgccatatcgtgctgaacttggaggacctttcctttatggacagctcggggcttggcgttattttaggaagatacaagcaaattaagcaaattggcggagaaatggttgtttgcgctatctctcctgcggtgaagcgattgtttgatatgtcgggtctgtttaaaattatccgatttgaacaatctgaacagcaggcactcctgacactgggggtggcatcatgaaaaatgaaatgcaccttgagttttctgccctcagtcagaatgaatcgttcgcccgtgtgacagttgcttcatttatagctcagctggacccgacaatggatgaactgactgaaatcaaaacagtcgtgtcagaggctgtcacgaatgcgattatccatggatatgaagagaactgtgaagggaaagtttacatttcagtgacgctggaagatcatgtcgtatatatgactattcgtgatgaaggcttaggcattacagatcttgaagaagcccgtcagcctctatttacgactaagcctgagcttgagcgctctggaatgggctttaccattatggaaaatttcatggatgatgtcagtatcgattcatcgcctgaaatgggaacaacgattcgcttaacaaagcacttatcaaaaagcaaagcgctttgtaattaaggagatttgttatggatgtggaggttaagaaaaacggcaaaaacgctcagctgaaggatcatgaagtaaaggaattaatcaaacaaagccaaaatggcgaccagcaggcaagagacctcctcatagaaaaaaacatgcgtcttgtttggtctgtcgtacagcggtttttaaacagaggatatgagcctgacgatctcttccagatcggctgcatcgggctgttaaaatctgttgacaaatttgatttaacctatgatgtgcgtttttcaacgtatgcagtgccgatgattatcggagaaatccaacgatttatccgtgatgacggaaccgtaaaggtatcacggtcattaaaagagcttggaaacaaaatccggcgcgcgaaggatgagctttcgaaaacactgggcagagtgccgacggtgcaggagatcgctgaccatttggagattgaagctgaggatgttgtactggcccaagaggcggtaagggctccatcttcgattcacgaaaccgtttatgaaaatgacggagatccgattaccctgcttgatcaaatcgctgacaactcagaagaaaaatggtttgacaaaattgcgctgaaagaagcgatcagcgatttggaggaaagggaaaaactaatcgtctatctcagatattataaagaccagacacagtccgaggtggctgagcggctcgggatctctcaggtgcaggtttccaggcttgaaaagaaaatattaaaacagatcaaggttcaaatggatcatacggatggctagtctgcagtgcaggctagcttttttgtgcaaaagcgtggtaatttatggtcttttcgagcggatgaatgagaacaaaatcgaaccacatactacatatataaccaccgaaagatggtgatcaatgatggaacgacgaatatttatccggcttcgccaccgagtgctggcacatccaggggatattattaccgttggagatgccgcgcaaatagaagggcagcttcagctgaaaaagaaactttcggctatgccgctttatcaggtgagcgaaaaagataaaaatatcgtaattctggatatcatacaagtcctcagagccattcatttacaagacccgacaattgatgttcaaaccgtaggcggagcagaaaccattgttgaaattcagtatcgaaagcgaaatttatcaacggttctatttatcggtgtctggctgcttctgtttattggatcgtgtcttgccatcatgaactttcatgaggatgtaagcatgagagatgttcatatcgcactatatgaaatcataaccggagagaggaatgactatccatatttgcttcaaatcccatacagcatcggtttgggactggggatgatcgtgttttttaaccacatatttaaaaagcgcctaaatgaagagcccagcccgctggaggttgagatgtttaactatcagcttgatctcgatcaatatgtggccatgcatgagaatcaagaaaccataaaggatctgcatgatcgttagtgtattgttcatcatttttgtcgggctcggcggaggcataacggtgggggcgggtttcgttgcttttttaaccgtaatgggaatcattccgcggctgatgcagctcaccaaaacaatgagatttgttcaggcttatgaagcggctgttattcttggcgcggtttgcgggggatgggagacgcttcatatgaatcatctttatctaacaaaatggatagctgtgccggtcgggcttctggcaggtttgttcgtcgggatgctagcggctgctcttacagaggttttaaatgtcctgccgattttggcgaaacgaatcgggctcagaagtaaaatcattattctgttaatggccatcgtgattgggaaaatcgcgggatctttatttcactggctgtactttattgaccattcataaggaggtttcaagatgacaaacataaaagaaaattacaaatcaaaagtgaaaacatatcagcctaagccgccttacgtctggaactgtgtaaaagcctttttagtgggcggactgatttgtgcaatcgggcaaggtctgcaaaatttttatatccatttttttgatttcaatgaaaaaactgcggggaatccaacagctgcaacgctgatattaatttctgccctgcttacagggtttggaatctatgacagaatcggacaattcgcaggcgcaggttcagccgtacctgtcacgggttttgccaacagtatggcaagtgcggctcttgaatataaaagcgaaggattagtgcttggagtagcgacaaatatgtttaaactggcaggaaatgttattgttttcggagttgtagctgcatacatcgttggaatgattcggtttgcttttgagaaactgatgtcataggaggagaagaaaatgaaattaacaggaaagcaaacctgggtatttgaacatcccatatttgtcaactcagcgggaacggcagcaggaccaaaggaaaaagacggaccgcttggctctttatttgataaaacctatgacgaaatgcattgtaatcaaaaaagctgggaaatggcggaacggcagctgatggaagacgctgttaatgttgcacttcaaaaaaacaatctgacaaaagatgatattgacctattgctggcaggcgacttgctgaaccaaaacgtgacggctaactatgtggcaagacacttgaaaatcccatttctttgtatgtttggcgcctgttcaacatcaatggaaacagtggctgtcgcatcagccttagttgatggagggtttgccaaaagggcactcgctgccaccagcagtcacaatgcaactgcggaaagacagtttcgctatccgacagaatacggaggccaaaaaccggacactgctacctccactgtaaccggaagcggtgcagttgtcatcagtcagacaccgggtgatatccaaatcacaagtgcgactgtcgggaaggtttctgatttaggaattacagatccttttgatatgggatcggctatggctccggctgcagctgatacgattaagcagcactttaaagatctcaaccggacagcggatgactatgatctaatcctgacaggtgacctgtcaggcgtcggttctccaatcgtaaaagacattttaaaagaagatggatatccagtcggcacaaagcatgatgattgcgggcttctgatttacactccggatcagcaggtctttgccggggggagcggctgtgcttgttcagcggttgtcacctactctcatatttttaagcagctgagagaaggaaaactaaaccgtgtatttgtcgtggcgaccggggcgctattaagcccgacgatgatccagcaaaaagaaaccatcccgactatcgcccacggggttgtatttgagcgtgcaggaggtgcatcttaacatggactaccttttggcttttgtctgcggcggggccatttgtatcgtcggccagctgctcttggatatttttaaattgacgccagctcatgtcatgacatcatttgttgtaatcggtgcaatattagatggtttcggcatttacgataaatttattgaatttgccggaggaggcgccaccgttccgatcgtcagcttcggtcacagtcttctgcacggcgccatgcatcaggcgcatatacacggatttatcggaatcggcatggggatttttgagctgacctcggccggtatctcagccgctattcttttcgcctttatcgtagctgttattttcaaaccgaaaggataatgccgacatgacgacaaaacgcaaggtcatactggtaacagacggggatgtttatgccgctaaaacaattgaatacgccgcaagcaaagtgggaggccgatgcatttcacaatcaaaagggaatccttccacccgcagcggcgccgagcttgtcaagctgatcgcctcagcaccgtatgatcctgtatttgtcatgtttgacgactccggccttcaaggagagggtccgggagaagccgctctaacctatgtcgcaacccatccgtctattgaagtgctcggtgtgattgcggtcgcgtcaaaaacacatcaggctgaatggaccagggtcgatgtaagcattgaccgcaatggagaaataactgaatacggcgtcgataaagtcggggaaagggaatttgatgaccacagaatgagtggagatacagtctattgccttgataaacttgatctcccgcttattgtcggtatcggggatatcggcaaaatgggcagaaaagacgatatctcaaaagggtcgccaatcaccatgaaagcggtcgagtttattttagaaaggagcgggtatcatgccggaccacaaggaagagaaaattcgggtttatcggaatccagctaaaaatgaagagtatttcaaaaaccgtgttgggatggggacgagctatgatgtaggtgttcgcaagctcacgattttagataaagagatccagctttactatctaaatggattatgcgatacagcctatattattcatttaatgagagagcttgttgccattaacaatcggaaagaagaccctgatgagctggtcgacatcgtcgaaaacaggctgcttaacgcccaggtcgaaaaagtaaaaaccttggatgaaaccaccgaccaagtgctgtccgggctcgtcgctgtcattgttgaaggtgcaggcttcgcatttataattgacgtcagaagctatccgggcagaaacccggaagaacctgatacggaaaaggtagtcaggggagccagagacggatttgttgaaaatatcgtcgtcaatacggcccttctcagaaggcggatcagagacgaacgccttcgagtcaagatgacgaaagttggtgagcggtcaaagacggatttaagcatttgttatatagaagatatagctgatccggatctggttgagatcgtagaaaaagaaattgcatccattgatgtcgatggattaacaatggcagacaaaactgtcgaggaattcattgttaatcaaagctataatccttttccgctcgtgcgctatacagaaagaccggatgtggccgcaaatcatgttctagaaggccatgttatcattatagtggacacatcgccgagtgtgatcattaccccgacgactttatttcaccatgtgcagcatgctgaagaatataggcaggcgccttcagtcgggacctttttaagatgggtaagatttttcggtattcttgcttctactttatttcttccgatctggtttctctttgtgcttcagcctgatctgctcccggacaacatgaaatttatcggtttaaataaagatacgcatatcccgatcatcctgcagatatttttagctgacttaggaatcgagtttctcagaatggctgccattcacaccccgacggctttatcgacagcaatgggtttaattgccgctgttctgatcgggcagattgcgattgaggtcggccttttttctcctgaggtgattctgtacgtctcacttgcggcgattggaacctttacgacgcctagttatgaattaagcttggcaaacaaaatgagccgtcttgtcctcatgatactcgttgccttatttcatataaaagggctcgtcatcggatttacagtgctaattattgccatggcaagcatcaaatcccttcagacaccgtacttatggccgctgattccctttaacggaaaggcgctgtggcaggttcttgtccgcacagcgaaacctggcgcaaaagtaagacccagcatcgttcaccccaaaaatcgcttaaggcagcctaccaattcataatcgcattgaaactgactgaagagtatgataatgtatgtcttaatcatgaagggacagtccataaaactgtcctttcatccataagcggagaaagagggaatgacattgttcttacacggcacaagcagacaaaatcaacatggtcatttagaaatcggaggtgtggatgctctctatttagcggagaaatatggtacacctctttacgtatatgatgtggctttaatacgtgagcgtgctaaaagctttaagcaggcgtttgtttctgcagggctgaaagcacaggtggcatatgcgagcaaagcattctcatcagtcgcaatgattcagctcgctgaggaagagggactttctttagatgtcgtatccggaggagagctatatacggctgttgcggcaggctttccggcagaacgcatccactttcatggaaacaataagagcagggaagaactgcgcatggcgcttgagcaccgcatcggctgcattgtggtggataatttctatgaaattgcgcttcttgaagacctatgtaaagaaacgggtcactccatcgatgttcttcttcggatcacgcccggagtagaagcgcatacgcatgactacattacaacgggccaggaagattcaaagtttggtttcgatcttcataacggacaaactgaacgggccattgaacaagtattacaatcggaacacattcagctgctgggtgtccattgccatatcggctcgcaaatctttgatacggccggttttgtgttagcagcggaaaaaatcttcaaaaaactagacgaatggagagattcatattcatttgtatccaaggtgctgaatcttggaggaggtttcggcattcgttatacggaagatgatgaaccgcttcatgccactgaatacgttgaaaaaattatcgaagctgtgaaagaaaatgcttcccgttacggttttgacattccggaaatttggatcgaaccgggccgttctctcgtaggagacgcaggcacaactctttatacggttggctctcaaaaagaagtgccgggtgtccgccaatatgtggctgtagacggaggcatgaacgacaatattcgtcctgcgctttaccaagctaaatatgaagctgcggcagccaacaggatcggagaagcgcatgacaaaacggtatcaattgccggaaagtgctgtgaaagcggagatatgctgatttgggatattgacctgccggaagtaaaagaaggcgatcttcttgccgttttttgtacaggcgcttatggatacagcatggccaacaattataaccgtattccgagacccgccgttgtatttgtcgaaaacggtgaggctcatttagtcgtgaagcgagaaacatacgaagatattgtaaaacttgatctgccatttaaaacgggtgtaaagcaataaaagaaagcgccgatttttcggcgcttttcctatttgaatatagatacaatcgcattccagatagatacgaagaaatcaatgactttctggatgaagtttttgccttcatctgattctatgaatttcgtaatcttatctttcgctttatcaagctggtcactgacctgtccccagtcaatgtcagcatttttcatcttattgaatagggagacaagctgattcttttggctgtctgtaagcgtgacatttaaatcagaagctgtgtcgtccacttgtttttcgatgtcagctttattatcaggcaccccgtttttagcaaactcttctttgatttttgcaatcagggctgatgcattttcgttaccgattttgtctccaagctctgatgtcgtgacaagctcttggttggcgacttgtttaacatcctccgagatcgcttcgtctgaagaaacttcatacgccttaatcaatccagttaaagccgcagtcccggatacttcaaacggtgctgtaacatacaccttcgcatctttcacaccggctgtcatcagtgcattcaggtacatttcatctgtgatgccgctgatattatgggtctcaacattcaatccggagccttttttggcaatggtgattgacgaagaagaaatcgctctcgatccgatttgcgcgtttgatatatattttcctaaatattcatgttcttctttattggtcacggttaccgttgtggcattatcagggacattcatttcatcaagcactttttgtttgtcggattctgacaaatcagcacccagtgttacaatgacatctccaactgcggcatccgcgagactgaccttcggaaccgtcagcagcaaaacggccgctgccagcattccaatccaaattttcttcaaagcagtttgacctccttcaatttcacaagcagctggatagtgctgctttgtgaggacctgaatcatgaaaaatacagttccgttaggttagacggagataaagagattcaggtttcatttttattttttagtaaagcccgggagattcgttttcccccgaaaggtgtggtataatagccgcgacaaggagagacaggctataacctatcatacataatctcctttgaaaattaaaataaagaaagtaggcatacaattgaaaacaggttactttttattagaagacgggaacaaaattgaatttgaactttatcctgaagctgcacctggaactgttgcaaactttgaaaagcttgcaaacgaaggcttttatgacgggcttacattccaccgagtgatccctggcttcgtcagccaaggcggatgcccgcacggaactggtactggcggcccaggatacacaatcaaatgtgaaacagaaggaaacccgcatacacatgaggcgggcgcactttctatggcacatgccggaaaagacactggcggcagccaatttttcatcgttcatgagccacagcctcatttgaacggtgttcacactgtatttggtaaagtaacaagcggattagaattcgcgaaaaacatgtctaatggcgatgtcatgaaagaagttcgcgtagaaggctaattggcaggcaaaaggcttcctcatatagagggagcttttttattgggtaaaaatattcaataaaaaaccgccgagtgctgatggcggttggcaaaaccaggtgtttagttagtgagacatcgcaagcccccgtaatgaatcgattaaaaagttttggtgacgttttgatcagtaaattgatgattaatcattttagctttgcttacaaagttattttcaaagacaattcctgtgtttaaacctccggagccaaacacagatttggacaaagttaaaggcctgatcataaaagcgccgcctacgttaattacactgttcccggaaacgttgtttatattaataggataatcaatcatactatcaagtctcctttcatatcattctattttttatatgtattagtgctagagttgattagcgtaaacttatcggcaaaaatatttaggagatgcctgtttttattgatttataaaaatgctcgaaaaaagagcctcctttaaagcttccggaagcccagatatctgtctattcttttaactactctgaatgcggcagctgcttttctggcgaatgtaataggatcatcctgtgctgactcaaagtgcatatacattgctcacggctcactaaataaccagtggttatgcaatgtagaaatcgccatacgccgctatcctagttcggtgagcaaagaatttacctcttcatgtaagaaactaagtgaaatactttaccatttcgaacctcaaacgggaaaaatggggaattgacaagggatgaggtgggcaaacaaacacctgactcggtggcagaacgaactgcccaaaattttggcaaactccctgcgtatcttttgtttcctcccatttcatgctattgctcctcctatgtcaaaaaagaatgtatgagagaagatcccgccatagacaatgttgttggacgactgaagataaaattgtgctgattatacaaaaagtggattgggaatgataaaagaacaaaaaagtttaaggagaatcacatgcaagttttgacagggttgctcgaacagtacggatatgccgtcttgtttattgtcttgatgttagagcttctagctttacttggaccgggagagtttgccggtgttctcgtgtttcaagaaaagttaaactgggtgctaagcatgttagcggccggattggggagctgtgggagtgagcatgtcgtattggatcgggtatagactgggcccagctgcaattcagaaagcttttgcgtcgagaggtgttctgttagccgttattgttctaacttttttttggacggtattcagagggcaagatcggaaaatcgaactctctttcttatttttcctagtcattggtggggagctttatgaagagggaatcagacggctctttcattcccttcatcctgttcacgctcctttggaaagtcatgtattatatccattcccgagcgaacagactttaacggcatttgtcatttttggtttttgtgcttatctttttgttcgtcattctcacaaggcgtgtctgcaaactgttgcgtttttttgtttattatcgttttattcctcatcgggctgagccgtgtgtacgttaatgagcagtatccgagtgatgttgctgcgggttacgccttcggcggtgtttggctgagtttgaatgttttggtcatggagcttttccgtttctccagaagatttaccaagctgagaaacgaacccaattagtatgtaatcaaaattaagtaaactttaaagtagtacgggtcattgggattgatattttgtagtaaaataaatcaaacaaacgtgatgtaatgaaagggagatcgcgatatgaacaacaaaggctgtataaaatgcggtagtactgaagccggacaaaaagaaatagctacaaccggcacgggattatcaaagctgtttgacgtgcagcataaccgatttctagtggtttactgtaagaactgcggatattcagagttttataataaagagtcttcaactgccgggaatatattggatttattttttggaggctgatccatgttttttttcgagcttgaatgattttaaacatatcatgaaagcaaaaacgggatgcggttatcacctgtgaaataggttgctgcaaacattccagtaacctttatgacgtgaattgttttttgtcaagtgccatgggtatcatggactgggagatcaatggaatgcagtaaatgaacaaactgctcgtaacctcatgctttatatacgatctaaagattttgcatatgagaactctctttcttctgagtccatcgcttctgaattatgcgattcatttctttcaatattttcaggcctagttatggtcgacaagaaaaaaataggcatgatgtgggtagaagatgaagattaacagtttgtaaaatcacttcaatggtcctaatgggattttttttcgattcgtgataacataaattgaagaccgttgtttattggaggaaatcagttgaaatcagaaaatgtttcgaagaaaaaatcaatattagaatgggcaaaagcaattgtgattgctgtcgttctcgctttgctcatccgcaactttatttttgcgccgtatgtcgttgatggtgactctatgtatcctacacttcacaaccgtgaaagggtctttgtcaatatgacagtcaaatacatcggcgagtttgatagaggagacatcgtcgtgttaaacggagatgatgttcactatgtcaaacgtattatcggccttcccggcgatacggttgagatgaaaaatgaccagctctatatcaacgggaaaaaggtggacgaaccttatttggcggctaataaaaagagagcgaaacaggacggttttgaccatttgaccgatgatttcggcccggttaaagtgcctgataacaagtattttgtgatgggcgacaaccgtcggaattcaatggacagccgtaacggtcttggcctcttcacgaaaaaacaaattgcgggtacgtcaaagtttgttttctacccgtttaacgaaatgcgcaaaacaaattaggatcaagcagtttcccattggggctgctttttttatatcttttttacggtcatcccctaaaaacagaacataaattcgtatatctatagaaaagaaatttttgcagaaatgtgaaacatattcccgttatgcatcgttatattaataatttacgagaatttacggttttttattcatgaaaaaaaggaataactcatatgaatgaatagattcatattggctggaggtttagaaatgggaagaataaaaaccaagattaccattctgttagtgcttttgcttttacttgcaggcggttatatgtacataaatgatgttgagctgaaggatgttccgacagcaattggacaaaccttgtcctcggaagaagaggaatacaccatccaggaatataaagtgacgagaattgagggctcagagtatcatggagtagcagaaaacggaacgaaaatcatcttcaacggaaaaaaattaaatcaggatttatctgatataaaagaaggtgacaagattaaggcatacttcagcaaatcaaagcggatcgacggattaatcaaggttgcaaaagtgaatgattaacaaaacatcacctttcggatcgaagggtgatgttttgtttttctcaaattgtaagtttatttcattgcgtactttaaaaaggatcgctataatagccaataaggacaaatgaataaagattgtatccttcggggcagggtggaaatcccgaccggcggtagtaaagcacatttgctttagagcccgtgacccgtgtgcataagcacgcggtggattcagtttaagctgaagccgacagtgaaagtctggatgggagaaggatgatgaaccgctatgcaaaatgtttaaaaatgcatagtgttatttcctattgcgtaaaatacctaaagccccgaattttttataaattcggggcttttttgacggtaaataacaaaagaggggagggaaacaaatggaagagtattatatgaagctggcattagatcttgcgaagcagggcgaaggacagaccgaatccaatccgctcgtcggtgctgttgtcgtaaaggacggacaaattgtcggaatgggcgcccatttaaaatatggtgaagctcatgcagaagttcatgccatccatatggctggagcacatgcagagggtgccgacatttacgttacactcgaaccgtgcagccattacggaaaaacaccgccatgtgcagaattgattatcaactctggcatcaaaagagtgttcgtggcgatgagagatcctaatccgcttgtggctggaagagggatcagcatgatcaaagaagccggcattgaggtaagggaaggcatcctggcagaccaggcggagagcctgaatgaaaaatttctgcactttatgaggacaggccttccgtacgtcacgctaaaagcggctgccagccttgacggcaagatagctaccagcacgggtgacagcaaatggatcacgtcagaggctgcaagacaggatgctcagcaatacaggaaaacacaccaaagcattttagtcggagttggcacagtgaaagccgacaatccgagcttaacctgcagactgccgaatgtaacaaaacagccggttcgggtcatacttgataccgtactctcgattcctgaggacgctaaagtgatttgcgatcaaatagcgccgacatggatttttacgacggcacgcgcagacgaggaaaagaaaaaacggctttcagctttcggagtgaacatatttacacttgaaaccgagcgcattcaaattcctgatgttttgaagatcctagcggaagaaggcatcatgtcggtgtatgtggaaggcggttcagctgttcacggaagctttgtcaaagaaggctgttttcaagaaatcatcttctattttgcccctaaactaatcggaggaacgcatgctcccagcttaatctccggtgaaggttttcaatcaatgaaagatgtccccttattacaattcactgatataacccaaatcggccgtgatatcaaactgacggcaaaaccgacaaaggaataggatggtgaccatgtttacaggaattatcgaagaaacaggcacaatcgaatccatgaaaaaagcagggcattcaatggccttaactattaaatgctcaaagattttagaggatgttcatcttggcgacagcattgcagtgaacggcatttgtctgactgtcactgattttacaaaaaatcaattcacagtggatgttatgcctgaaacagtcaaagctacgtcactgaatgatttaacaaaaggaagcaaagtaaatctggaaagagcgatggcggcaaacggccgtttcggaggccatttcgtctctggccatgtcgacggaactgcggaaatcacacgaattgaagagaaaagcaacgcagtttactatgatttaaaaatggacccatcattaacaaaaacattggttttaaagggatcaattactgtggatggcgtgagcttaaccatattcggcctgacagaagacacagtgacgatctccttaataccgcatacgatcagcgaaacgattttttcagaaaaaacgatcggctctaaagtgaatatcgaatgcgatatgatcggaaaatatatgtatcgatttttgcataaagccaatgaaaataagacccaacaaaccattacaaaagccttcttaagcgaaaacggcttttagagaggaagatttgcatgtttcatccgatagaagaagcactggacgctttaaaaaaaggcgaagtcatcatcgttgtagatgatgaagacagagaaaatgaaggagactttgtggctcttgccgagcatgcaacgccggaagtcattaactttatggcgacacatgggagaggactgatctgcacgccgctcagtgaggaaatcgcagacaggcttgatcttcaccctatggttgagcataatacagattctcaccacactgcatttaccgtaagcatagaccatcgtgaaacgaagacaggtatcagcgctcaagaaagatcttttaccgttcaagcattgctggacagcaaatccgtgccatctgattttcagcgtccggggcacatttttccactgattgcgaaaaaaggaggtgtcctgaaaagagcgggccatacagaagctgctgttgatcttgctgaagcttgcggatctccaagagccggcgtcatttgtgaaattatgaatgaagacggaacgatggcgagagtgcctgagctcattgaaattgcgaaaaagcatcaattaaaaatgatcaccattaaggatttgattcaataccgttacaatctgacaacacttgtcgagcgtgaagttgacattacgctgcctactgattttgggacatttaaggtttatggatacacaaatgaggtagatggaaaagagcatgtcgcatttgtgatgggagaggtgccgttcggagaagaaccggtattggtccgggtgcattcagaatgtctcacaggtgacgtgtttgggtctcatcgctgtgactgcggaccgcagctgcacgcggcgctgaaccaaattgccgcagaaggccgtggagtgcttctgtacttgcgccaagaaggacgaggcatcggtttaatcaataaattaaaagcttataagcttcaggaacaaggctatgacaccgtagaagccaatgaggcgcttggattcttgccggatcttcgcaactatggcatcggagcacaaattttacgcgacctcggtgtccggaatatgaagcttttgacgaataatccgcgaaaaatcgcaggccttgaaggctacggactcagtatttcagaaagagtgccgcttcaaatggaggcgaaagaacacaataaaaaatatttgcaaaccaaaatgaacaagctaggtcatttacttcatttctaatcacaaatatcacaaaaaaggatgggaatcatatgaatatcatacaaggaaatttagttggtacaggtcttaaaatcggaatcgtagtaggaagatttaatgattttattacgagcaagctgctgagcggagcagaagatgcgctgctcagacatggcgtagacacaaatgacattgatgtggcttgggttccaggcgcatttgaaataccgtttgctgcgaaaaaaatggcggaaacaaaaaaatatgatgctattatcacattgggcactgtcatcagaggcgcaacgacacattacgattatgtctgcaatgaagctgcaaaaggcatcgcgcaagcagcaaacactactggtgtacctgtcatctttggaattgtaacaactgaaaacatcgaacaggctatcgagcgtgccggcacaaaagcgggcaacaaaggtgtagattgtgctgtttctgccattgaaatggcaaatttaaaccgctcatttgaataatttgctgaaaacagtttaaaaatatggcgaaaatgatataatgtgagaaaacggatcacctattcgtatccgttaatagcagactggacattttggatatagaggggtttttatgttaattcgttataaaaaatcgtttgaaaagattgcgatggggcttctttcgtttatgccgaatgaaaaagaccttaagcagcttcagcagacaattaaggactacgaaacggatacagaccgccagctctttctttggaaagaggacgaggatatcgtcggagcaatcggagtcgaaaaaaaggattctgaggttgagatccggcatatcagtgtgaatccttctcatcgccatcaaggaatcggaaaacagatgatggatgctttaaagcatttattcaaaacgcaagtactggttccaaatgaattaacgcagagctttttcgaacgttgtcaaggtcagcaggatcaagacatttcatacaataattaagcagaggctgtcatcagcctctgctttagtttgatgacaaaatccgaaaacagttttgttttaggtttttgtcatcctttcagcgcgattgaaaacccttgaagtctaggaaagctgagcattggagcggagcgaatgttttcattcgtgagcaccaacgcacaggcttgacaacgaaagcgagggtttgtcgacacgctaagcagaggctgtcatcagcctctgctttagtttgatgacaaaatccgaaaacagttttgttttaggtttttgtcatcctttcagcgcgattgaaaacccttgaagtctaggaaagctgagcattggagcggagcgaatgttttcattcgtgagcaccaacgcacaggcttgacaacgaaagcgagggtttgtcgacacgctgagcagaggctgtgatcagtctctgcttttttttctgcgttctatttctttttcacgttcacggatgacgtcagtccgatcccgcaaacggtgtttgtcgataagaaatatgttcctgagtgcactgggctgcccccatgtatacttttttttcctgcattcgatcctgcatgcttcctccagtttctcatctttgattggcagcataatgcttttataggcagagccggtttcgatttgttcgtaaaccgattgcataagctcgagcaaacggccatgatcgagccctaagtcttcgactgcccggtgttctgctttgagaattcggatgctgtttgccatcagtctttttgccccggctgtattctgccttctgtgatgatataaagcaactgcaagctgaataaagccgacccaatagcgttttcgtttctttggcggatcttccttccaatattcttctaatatttcatggcattcaaaataatcccgtgtcgcgtgaaactcaacgagataatctatataagctttcggatacaaggtgcttcctcctttaatgtgcttttagtgtaccatagaagggataaaaggaaaaaagaacgctcggcctctattgcttcttagaaaggaaaaccagaagctaaggctttttctcccgcttcagcgctccgagcaaacacctctcgtgttttgaatattctgtacaaacttgttcaaaacaggaaatgaaatagtattggacgagagctttttggtggcttatactatagggtagccagtttttccggcaatgagagtgatacttgaaaatggtgagatgatggaagaatatcaagtgaaaattgatacgtttgagggcccattggacctgctgcttcatttaatcaatcgtcttgaaattgacatatatgatatacctgtggcgaagatcactgaacaatatttattatatgtacatacgatgcgtgtgcttgagctcgatattgccagcgagtatttggttatggctgccacgctgctcagcattaaaagcagaatgctgctcccgaagcaagaggaggagctttttgaagatgaattgcttgaagaagaagatccgcgggaggaactgattgaaaagctgattgagtatcgaaaatataaagatgcggcgaaggaattaaaagaacgggaagaagaaagacaaaaatcgttcacgaaaccgccgagtgatttgagtgaatatgcaaaagaagtaaaacagtctgagcaaaagctctctgtcacggtctatgatatgatcggagcttttcaaaaagtgctgaaacgcaaaaaaataaacaggccgatggaaacaacaattacaagacaggacataccaatcgaagccagaatgaacgaaatcgtgcacagcttgaaatctagaggaacgagaatcaactttatggatctgtttccatatgagcaaaaagaacatttagtagtgacctttctagctgttctcgagctgatgaaaaatcagctggtcctcattgaacaggaacacaatttttcagatatttacattacggggagtgaatccattcatggggcttgatatcgtgaattggaaagctattgtggaagcccttctttatgcggcaggcgatgaagggcttacaaaaaagcagctgttaacagtgcttgaaatcgaagagcctgaactgaacacgatcatggcggatgtggcggacgaataccgcggagatacacgagggattgaacttattgagtatgcagatacgtacatgctctctaccaaaaaagactttgcgccttacttgaaaaaactgattgaagtgccgtcaaagggcctttctcaagcatctttagaagtgctggccattgtttcatacaaacagccaattacgagagcagaaattgaagaaatcagaggagtaaaatcagagcggatattacacagtcttgtcgcgaaggcgctattgtgtgaagtagggcgtgccgatggtccggggcgggccattttatacggtactacgccgacttttcttgaacaattcggtctgaaaacgctggacgagcttccgccgctgcctgaaaatgcggaagaagacgttcttcaagaagaagcagatttattttttgaaaactttaaccaaaccttcgaagatataaaatagaagtttaatgaatcgcgctttttcatcatcataagatataaggaagaagctatcatgaaagaagcaaaatgtgagagacaaagacatgaggggaagataccaaacgaaatgggacattcgattgtgcgagcgcagactcaaaaaacaggcgaattcttatcaatggttgtcaataccgtgaacgattacctaaatcaaacgacgcttgagtccttacaggctgaattgcctattgaaaaaggatactgctgtgatgtgctgagcactctgagaagaatggcagtattttgtgaaggaggcgcagaagcgtgccgccgtctcctgatgcaggagccttttcaggaagccagagcggaaaaaacactttataatgtgtatcaccaatgcattgaagagttctttatgccgaaaaaagacacgtggtgtgaaaatagccgggcgtcttataccggggtcagcgcaattgagttttatcatgctgttcctgcgtcgcttgagcaattattattgccgttgagcgcggcctttctgaagatgagggaagagctggctcattacgaagcgtccggatcaagcatggcgccaatcagataacgtttactctccctttttcagggagagtttttttatgtttgcttccagaaatataattgttattcataactgatggacatgcgcataaacttgtacaaaccaccacaaggacgtgagcaaacatgcgcattttcaaaaaagcagtattcgtgatcatgatttcttttctaattgcaaccgtaaatgtgaatacagcacatgctgctatagatgtcagtgcaaaaagcgcgatcattattgacggtgcgtcaggcagagtgttatatgccaaggatgagcatcaaaaaaggcggatcgcgagcatcacaaaaattatgaccgccgtcctcgccatcgaatccggcaaaatggatcaaacggtgacggtttcggcaaatgctgtcagaacagaaggctccgccatttatttaacagaaggtcaaaaagtgaagctaaaagatcttgtgtatggcctgatgctaaggtcaggaaacgacgccgctgtcgcgattgctgagcatgtcggtgggagcctcgatgggtttgtttatatgatgaatcaaaaagccgagcagcttggtatgaaaaacacccgttttcaaaacccgcacggattggacgaccatgaaaatcattattcaacagcctatgacatggccattttaactaagtatgctatgaagctgaaagactatcaaaagatttcaggcacaaaaatatacaaagcggaaacgatggaaagcgtatggaaaaacaaaaataaactgctgaccatgctatatccgtacagcacaggaggaaaaacaggctatacaaaacttgcaaaacggacactggtctctacggcttcaaaggacggcattgacctgatagccgtcaccattaatgaccctaatgattgggatgaccatatgaagatgtttaactatgtgtttgagcattatcaaacctatttaattgcaaaaaaaggggatattccaaagctgaaaggcacattttatgaatcgaaggcttttatcaaacgtgatatcacctatttgctgaccgaagaggaaaaagaagatgtaaaaattaataccacactgctcaagccgaaaaaagcatgggaaaaagatgcctcgaaaatccctgacatcgtagggcacatggagatcatgttcaacgatgcaaccatcgcaaaagtgccgatctattatgaaaatgagcggcatcaaaaaccgaagaaacaattttttgaaacgtttaaatcaatctttctgaatgcggcaggcggagcaaaatggtcaatataatttgggtcagtttaaccgtgatcggactcgtttttgcgatgtgcaacggaactctgcaagatgtaaatgaagccgtgtttaagggtgcaaaagaagcgattacgatctcattcggattgatgagcgtgcttgttttctggcttggcttaatgaaaatcgccgagcagtcagggcttttggatattttcagccggatgtgcaggccttttatatctaaactgttccctgatataccgccggatcacccggcgatgggctatattttatctaatcttatggcgaatttcttcggcctcggaaatgcagcaactccgcttggcattaaagcaatggaacaaatgaaaaagctgaacggaaaccgatcggaagcaagccggtcgatgattacttttttagctgttaatacgtcctgcatcacactcatcccgacaacggtgatcgctgtccgaatggcttattcctccaaaacgccgacagatatcgtcgggccaagcattttggcaacgcttatttccggaatcggtgccattatcattgatcggtatttttattaccgccgcaaaaagaagggaaggtgagcggatggaaatcatcaactggctgtctttagccatgattccaatcattattgccggaattcttctttatggaacgatcaaaaaggttccgacttatgaatcgtttgtcgaaggcggaaaagaggggatagaaatcgccttttccattatcccctatttagtcggaatgcttgtcgctataactgttttcagatcatcaggcgcgcttgattttataatggatcttttaaaaccggctttctccgctatcggcatccctgctgaagtagtgccgcttgctctgatccgcccgatctccggtacggccgcactcggaatgacgaccgatttaattgcagtatacgggcccgattcctttatcggcaggctggcttccgttatgcagggatctacagatacaacgctttacgtactgactgtgtatttcggagcagtcggcattaaaaaaatgggtgatgcattaaaggtgggacttcttgcagatttaatcggcgtagttgcatctatcatcatcgttacgttattatttgggagcgcctgaaaacggcgttttttttagatttggcataggaatttgaaaaagcttgtttgttaaggttgaaaaaagtaagataatacttgaggtgaaagacatggaaagactgcaaaaagtgattgctcatgccggagttgcgtcgcgcagaaaggcagaagagctgattaaagaaggaaaagtaaaggtgaatggcaaagtagtaacagagctaggtgttaaggtcaccggttctgatcagattgaggtaaacgggttaaaggttgaacgcgaagagccggtttactttctcttatataaaccaagaggcgttatttccgcagcgcaagatgataaaggacgcaaagtggtgacggacttttttaaaaatattccgcagcgcatttatccgattgggcgtctggactatgatacgagcggtcttttgcttttaaccaatgacggcgaattcgccaataagctgatgcaccctaagtatgaaatagacaaaacatacgtggcgaaggtgaaaggaatcccgcctaaagagctgctcagaaagctggagcgcggaattaggctggaggaaggcaaaacagcgcctgctaaagcgaagctgctgtctttggataagaaaaagcagacaagcattattcagctgacgatccatgagggacgcaacagacaggtgcgccgcatgtttgaagcgatcggacatgaggtaatcaagctgaagcgtgaggaatacgcgtttttaaacctgcgaggcctgcacacgggcgatgccagagagcttacgcctcacgaagtaaaaaggctcagagcactggcggatcacggtaaaaacgctttctaaatttcacataaccttcaaaaagtaagaaatgtgaaatgaacgtgcaatgatataattgaatggatctgcaatagggggaagggggcagtggacaatgaagaaaaaaaggcgtttattcattcggaccggcatccttctcgttttaatctgcgcactcggctataccatttacaacgctgtatttgccggcaaagagagtatatccgaagggtccgacgcaccgaattttgtccttgaggatacgaatgggaaacgtatcgagctcagtgacttaaaagggaaaggtgtttttttgaatttctggggtacatggtgtgaaccgtgcaaaaaagagtttccttatatggcaaaccaatataagcattttaaaagccaaggtgttgaaattgtcgctgtaaatgttggggagtcaaagatagcagtacataattttatgaaatcctacggagtcaatttcccggttgttctggatacagatcgccaagtgcttgatgcctatgacgtatctccgcttccgacaacctttttgatcaatccggaaggaaaagttgtcaaggtggtgaccggcactatgacagaaagcatgatacacgattatatgaatctcataaaacccggagagacttcgggatgaagcaagtcaaatgtgaatgcggacatataaacccggtcggaactgttttatgcgaatcgtgcggaagagctcttcaggaaactcaacctccgctcgctgatatgagatatgacggaagcgcaagacgttcgcaaacctataacaaaacgatcatcgacaaaatttggaatttcttttcctcggttaaggtgggaatatggcttatcgtcataacccttgccgcatcagcgttcggcaccatttttccccaggaagcctatctgcctccgggcgcacaggctgatacttattacaaggagcagtacggcacgttcggccagctttattatttgctcgggtttcatcatttatatggttcttggtggtatttgctgctcattgcctcgatcggcatttcactcgtgatttgcagccttgatcgggtcattccgttgtatagagcgttaaaaaaacaaggtgtcagaaggagcccggcctttttaagaaggcagcgcttgttcagtgaaacagttactgtactgaacggggaatcgaaagaaaagatagttactctattaaagaaaaaacattatagaatcagagaaaaagagggcagcattcttgctgaaaaaggacgcttttcccgctggggcccgtatgtcaaccacattggattgatcatctttctgattggtgcgatgctgagatttgtgcctggcatgtacgtcgatgagacgctttgggtcagagaaggcgaaaccgcagcaattccgggtacagacggaaaatattatttgaaaaacaatcaattcagcgtagagacctataacagcaaaacggaaaaaaaggtatttgcagatgccattgacagagtcggggacggtagagtggcaaagaactttcaaaccgatgccgtactctacaagagagaaggaaaaattgtttatggcgagaagccgaagctgaaaaaagtaacagaagaagacatccgtgtcaatcagccgctgcgttttgattctttttccgtttaccaggtggattacaaagagaatcagcttgaccaaatggtgttccagctgattgataaaaaaacaaaaaaatcctttgggagcctgaagatcaaccttctggatccagattcagtctatgatcttggcaacggttacaaggtggaaatcgccagctacctgcctgacttctattttaatcaggacggagagccgagcacaaaaacaaagatccctaacaatccggcttttgtctttaatatcataacgccggacaaaccgaaaggcgaaaagagctttgtcgccatccaagaaaccattgaaggatcaggcaataataaatacaagctgaaatttgaccatgtcgaaacgaaaaacattactggacttacagtcagaaaggatctgacactctgggtacttgctgtcggcggagccatttttatgatcggtgttattcaaggtatgtactggcagcatcgaagaatttggctgcactcacaggacggtgcagttatggtagcggggcataccaataaaaactggtttggcctgaagaaggatttagcatttatattggctgattccggactgactgaaccggtggaccaaaaagaattaatcaaaacacagaaataggcgaaaagggagtgatgtcatggcagagctgagcggaaattttctttatgcggcctttcttgtgtatttaatcgctgtcccaatcttcggcggggccatacgcgggaataaagataaaaagggcaggccaaaccgatgggccaacattggaatcaccctttctattgtcggttttttctgccacctaggatatttcatcacaaggtgggctgccagcggccatgcgcctgtcagcaatatgtttgaattcaccaccgcttttggcatgatgcttgttttggcgtttattattctttattttctctatagattgccttcattaggcctgtttacgctgtcaattgctttattgctgattgcctacgccagcatgtttccgacagatatctcgcctttaattccttcgctccaaagcaactggctgtatattcacgtaacaactgccgcgcttgggcaagctatacttgccatcagctttgtcgctggtgtcatctttcttttgaagcatgtagaccagacaaagccaagcaaaaagaccttctggcttgaagcgattatgtttatcctggtcacaaccgtcgcctttattgcaatcacatcagcatttcgtcttgcaggctatgaagcggagtttaactgggtggacaaaagtaaagaaaaaaacgtgatggtgtacgaaatgcccgcgcttgtcggtccgcatcagggagagcttttgaccgaaggaagaatggaaccgcttgttgatcttcccgcgcttttctcaggcagaaaagtgaacactgtcatttggtcatttggagcaggtcttgtgttgtatggggctctccgtctgatcatcagaaaaagaatcagcgctctattacatccgctggtgaaaaacgtcaatcttgatctggtggatgaggttgggtacagggccgtatcaatcggatttccgatctttacactcggcgcgctgatctttgcaatgatttgggctcagctcgcctggaccagattttggggctgggaccctaaggaagtatgggcgctgatcacgtttttgttctatgccgcttacttgcacttaagactgtcaagaggctggcacggtgagaagtcagcatggctggccgtaatcggttttgctattattatgtttaatttaatattcgtaaatcttgtgcttgccggacttcattcttatgcatagtcctttgaaagcgacacagttctcaaactttctcacgatttgataaaatgaaagtaacagaaggaaagcagggggaaaacatggaccaaacgaacgaaacaaaaatattagtagttgatgacgaagccagaattcgccgccttttaagaatgtatcttgaacgtgaaaattatgctatagatgaagctgaaaatggtgatgaagccattgccaaagggcttgaagccaattatgacttaattttgcttgatctgatgatgccggggactgatggaattgaagtgtgccggcaaattcgtgaaaaaaaagcgacacccattattatgctgaccgcaaaaggagaagaagcaaaccgggtgcaggggtttgaagcgggaacagatgattatattgttaagccgttcagcccgagagaagtcgtgctgcgtgtaaaggcccttttgagaagagcatcccaaacctcttatttcaatgccaatacaccgacgaaaaatgtgctcgtgttttcacatctgtcaatagaccatgatgctcaccgcgtaacagctgatggaacagaagtgagcctgacgccaaaagagtatgagcttctatatttcttagcgaaaacgcctgacaaggtgtatgatcgggaaaagcttctgaaagaagtgtggcaatatgagttttttggtgatttacggacagtggacactcacgtcaaacgcttgagagagaagctgaacaaggtatctccggaagctgcgaaaaaaattgtcaccgtatggggtgtaggttataaatttgaggtcggcgctgaatgaaattttggaaaagcgtagtaggcaagctgtggtttacgatcctttcactcgtcttgatcgtattgttcattttaacggttcttttgctggagtttattgaaaactaccatgtggaagaagctgagaatgatttaacacagcttgcgaataaagttgctgtcatcctagaaaatcacgaggaccaggcactggcaaggtcaatcacttgggaactcgctgataacttaacaagcattgccatcatccaggatgagaagaaccactggtattctccgaatgataaaaatcgcctgtcgtctattacggttgagcaaatacagcatgacaaagacttaaataaagctctcaaagaccataaaaaagtaagcaaacggacgggactgagcgatacagacacggataatgaacgcctgattgtaggtgtcccgtatgaaaaagacggaaagaaaggcatggtctttttatcccagtctttgcttgccgttaaagatacaacaaaacatacgacccgctatatttttcttgccgctggaattgcgattgtgctgaccacatttttcgcattctttttatcaagcagggtcacgtaccctctccgaaaaatgagagaaggcgcgcaggatttggcgaagggcaagttcgatacaaaaatcccgattttaactcaggatgaaatcggtgaactggcgaccgcttttaatcaaatgggccggcagcttaactttcatatcaatgcgctcaatcaagaaaaagagcagctttctaacattttgagcagtatggctgacggggttattaccattaatattgacggtacgattcttgtgaccaacccgccggctgaacgttttcttcaggcttggtattatgaacagaacatgaatatcaaagaaggcgacaaccttccgcctgaagcaaaagagctgtttcaaaacgctgtcagcactgaaaaagaacaaatgattgagatgacgctgcaaggcagatcatgggtgcttttgatgtcgccgctttatgcggaatcgcacgtcagaggagcagttgccgtactgcgtgacatgacagaagaacgccgccttgataagctgcgggaggactttatcgcaaatgtcagtcatgagctgagaacaccgatctccatgcttcagggatacagtgaagcaattgttgatgacattgcaagctctgaagaagaccggaaagaaattgcccaaatcatttatgacgaatcgctccgaatgggccgtttagttaatgatttgcttgatttagcccgaatggaatcaggccatacaggcttacattatgaaaaaatcaatgtgaatgagtttttagaaaagatcattcggaagttttccggtgttgcgaaagaaaaaaatattgctttacatcatgacatttctctcacagaagaggaatttatgtttgatgaagacaagatggagcaggtatttaccaatttgatcgataacgcgttgcggcatacttcatccggtggtagtgtctccatttcagtccattctgtgaaggatggattgaaaattgatatcaaagactccgggtccggcataccggaagaagatctgccatttatctttgagcggttttataaggcagataaagcgcggacacggggcagagcaggaaccgggttagggctggctatcgttaaaaatatcgtggaagcccacaacggatcaattactgtgcacagccgaatagataaaggaacaacatttactttttatattccgacaaaacggtaaaatcgagtctgaatttgccgaagaatcttgttccataagaaacacccgctgactgagcgggtgtttttttaatagccaacattaataaaatttaaggatatgttaatataaattcccttccaaattccagttactcgtaatatagttgtaatgtaacttttcaagctattcatacgacaaaaaagtgaacggaggggtttcaaatggaagaaacctttcaattattatatgatacatatcatcaagatttgtaccaatttttattttatatggtaaaggataaaaaccagacagaagaccttcttcaagaggtttatatccgggtattaaattcttatcatacgtttgaaggaagaagcagtgaaaaaacatggcttttgtctatcgcacgccatgttgcgatagactggttccgtaaacagcaaacaatcagacagcgtatactcggtacatttgactgggatacacaggatgtcagggatcagcaattgctgccggacgaacttgcggttcaacatgaaaatgtccgggaaatttatgctgcgcttgatcaatgtacaatcgatcaaagagctgtgattatcttgcggtttattcagggatattcaatacaggaaacagccaaggctctgcgcttctcggaaagcaaagtaaaaacgacccaacacagagggctcaaagtacttcggaaacatatggagcttttgagggaggagctaatggatgatgaagtcagaatggaacgaagaacagataaaggagttgttaagtcaacttccggcagttaaagaccatcgttcgcctcaggatatttacaagcggctgacgatggcaaagcgtaaaaataagcccgctgtcaggtggattggccccgcgtgtgccgctgcaattgcggtttatatcgccttcattattactcctcatttctttgatcaggcacagcctcaacaaaaagaagcgtcccaagagaacgcagtaacgaaaactgagacagaagacagcccaaaagctgcatcatccctggatcatacatcgtttgttgtacctgaaaaggaacaagacaattacatcactgtagcagttgctgatgccgatacatctgcaattatacccgtcagcattcaaaaaacaaatgcataccaaacgatccaggacatgctgactgtaagtagtgaattggatatcttggatcatgccattacaattccatccttcatagatgaagtagaaataaaagaaaaaccaaagcagaaggaattaagtatacgagtccatcagccagctacggcattttctgtaaaagatgatacactgttaaaaaaattgcttaaagaatccttaaaatggagtccttatgaaaaagtcaaatttttatcggatcaaaatgagactggggttcggattggctcatatggcacttttacggaaatttcgattcccaaacagtcaaaaagagcttactacttgtacaaaaataaacaagggaactttctcattccgtcagaaaaaacatttgatacagtaaaagaagcgattagggaaatggaatcgagcagccaagaagatacgacacctcttattcaagcgggtgctgtccaatctgtaacgaagaaacagaaacacttatatatccgcttttcaaaggactcagaagttgaggattctattgccggtattttaatgattgagggacttcttttaaccgcaaaagagtttggcttcacagaagtgacctttaccgaaaccagaacaaacaaaatcggcaaatatgacgtatcagatgcaattccggtaccggctgctccaaatccgattttcttaaactaaaatgggccctttgaggctcttttttagttgctattcatataatagaaattttcaaaaaaaagttgtacgtgtataataaaacaaggtaacgattgaaaggatttgagatgagtgaacgtgttaacaattaaaggagtttccatcggggaaggaatgccgaaaatcatcgttccgctgatgggaaagacggaaaaacaaattctgaatgaagcagaggcagtaaaattactgaatccggacattgttgaatggagagtcgacgtatttgaaaaagcgaatgacagagaagcggtcacaaagctcatttctaagcttcgtaaatctttagaagacaagctatttctatttacattcagaacccacaaagagggcgggagcatggagatggacggaagctcctatcttgctttgctggaatcggcaatccaaacaaaagacatcgatctgatagatatcgaattattttcaggagatgcaaatgtaaaggcgttagtatcgctggcggaagaaaacaacgtctatgtggtgatgtcaaatcacgactttgaaaaaacacctgtaaaagatgaaattctttccagacttcgaaaaatgcaggaattaggcgcgcatattccaaaaatggctgtcatgccgaatgatactggagatctcctaacgctgcttgatgcgacgtatacaatgaaaacaaaatatgcagaccgtcccattattacaatgtcaatggctgcaacagggcttatcagcaggctgagcggtgaggtttttggatcggcttgtacttttggagctggagaagaggcgtccgcaccaggccaaattcctgtttctgagctaaggagtgtcttagatattttgcataaaaacacacggggatagaacaataaaaaaactcaagctatatagcttgagtttttttgattatggcagatcaatgagtttcacagacacaatatcagggacatttgttagttctttcacaattttatcttccagatgtctgtcaaaggaaagcatcatgatggcttctccgcctttttccttacggccaacctgcatagttgcaatgttaatatcattatctccgagaatacgtcctactcggccgatgacacctgttgtatcttgatgctggatatacaccaagtgacctgtcggataaaaatcaatattaaatccattgatctcgacaattcgttctccgaaatgaggaatatacgtagccgttacagtaaaggtgctgcggtctcctgtcacttttacgctgatgcagttatcgtatccagattcagaagaggaaattttttcactgaagctgatgccgcgttcttttgcgacacccccggcattgacctcattaacagtagagtctacgcgcggttttaaaaagcctgacagaagggcttttgtaatgaacgatgtttcaagtttagcaattgtgccttcatattgaatggcaacatcctgtactggttctttcatgcactgtgatacaaggctgccaatttttcctgcaatttgatggtaaggcttaattttagcaaattcatcttttgtcatggcaggcaggttgatagctgacatgacaggcaggccttttgcgaactgcagaacttcttctgacacttgggcggcgacattgagctgtgcttctttcgttgatgctcccaagtgaggagtggcaatgactaatggatgatcaacaagtttgttgtcaactggcggttcaacttcgaaaacgtcaagagccgctcccgcaacatgcccgttttccaaagcttcgagaagtgctgcttcatcgataattccgcctcgcgcacagttaattaagcgaacgccttttttcgtttttgcaatcgtttctttattcaataagccttttgtttcttttgttaaaggcgtgtgaacggtaatgatatccgcactttcaagcacttcttcaaatgtacggctgtttacgccgatttttttcgctctttcttccgttaagaaaggatcaaaaacgtgcacagtcataccgaatgctctcgcacgctgtgcaatttcacttccgattcggcctaatcctacaataccaagcgtttttccataaagctctgaaccgacataagctgtgcggttccactctctggatttcactgagatattagcctgcggaatgtgtctcattaaagaagagatcattgcaaatgtatgctcagctgtcgaaatggtgttgccgttcggagcattgatcacgattaccccgtgtttcgtagcctcatcaatatcgatattatcgacaccgacaccggctcttccgacaatttttaaagaagtcattttgttgaaaaggtcttctgttacttttgtcgcgcttcgcaccaaaagagcatcaaaagtatgtaattcatcttctgcatctgctacgtttttttgaacgatttcaataaagtctgattcaataagtggctgtaaaccgtcgttgctcattttgtctgagaccaatactcgaaacatcgttagatttcctcctaaattgacaaactaaatatctgataatttaacatattctcaaaagagtgtcaacgtgtattgacgcagtaaaggataaaagtaaagcctaataaatcaatgatttgacagcttgcaggtaatatatttaatttgaagcaattctctatacagccaaccagttatcgtttataatgtaattaaatttcatatgatcaatcttcggggcagggtgaaattccctaccggcggtgatgagccaatggctctaagcccgcgagctgtctttacagcaggattcggtgagattccggagccgacagtacagtctggatgggagaagatggaggttcataagcgttttgaaattgaatttttcaaacgtttctttgcctagcctaattttcgaaaccccgcttttatatatgaagcggtttttttattggctggaaaagaacctttccgttttcgagtaagatgtgatcgaaaaggagagaatgaagtgaaagtaaaaaaattagttgtggtcagcatgctgagcagcattgcatttgttttgatgctgttaaatttcccgtttccgggtcttccggattatttaaaaatcgattttagcgacgttcccgcaattattgccattctgatttacggacctttggcgggtattgccgtagaagcgataaaaaatgttcttcagtatatcattcagggaagcatggccggagttcctgtagggcaagttgcgaattttattgcaggaacactctttatattaccgactgctttcttatttaaaaaactcaactcagcaaagggcttggctgtcagcctgcttttgggaactgcagcgatgaccattttaatgagtattttaaattatgttctgattcttccggcatacacgtggtttttacattcaccggcattatccgacagcgcgctaaaaacagcagtcgtcgcaggtatcctgccgtttaacatgataaaaggtattgtaattacggttgtattctcactaatttttatcaagcttaagccatggattgagcagcagcgaagtgcacatatccattaaataaaaaagctcccgttcgggagctttttttagttacttctattcaaatttaagcgggtcgccttcaaatggctcatccgccactttgatggaatcagtagggcatccttcaaatgcgtcaatcatatcttcttccagtacctcaggaacttcgacaacacctttgttttcatcaagcgttacgaacgcgatgccttcatcatcgtaatcgtaaatgtctggtgcagcagctccgcaagcgccgcatgcaatacatgtatctttgtctacgattgtgtactttgccatgaataaaacctcccagattgttcttggtggaacaaatggatcaatctttatatttaatcaatttaacacctattcctcttacttattgtaatgatgttgctgccacatttcaacagaaaaatgattgagaatgcttatcacataaggggttatctacataacatcccccttaatgatgactttaaacgtcgatttctgtttgaaatctgttaaaataaaaagagcaaatcaacgatttttgtcaggaagaatgtaggtggataggttgtcattaaattacttcgatattatggttctcgattgtctttgcaaaataaacggggaacggtcgggaagcgctgtttttcacctattcaaaggcaagagatcgtcacagaccattcaagatgctggcttatttcagactgcaaaatactttggaatggcggcaaaatgttcgagaagcgatatttctgcgtcgcttgacaagcttgaaaagcattcatatctcgcgccaatgtctgaatcagatacatacaaagtgacagccagcggcgcagcagttttgagacatgcccttagcgagcggccttggcccgttcattgtcacggcgctcattatcagcaggctgccggcgtgctttggaaaaggctttcgctgcttgtgcaggtcctatcccataaacagcaagggagcaggcagtatatccctgtcacaaaggatcataagacacttcactgggtaaagaaatacctgtcccggcatacggatcatatagagatggcaaaaagcctttttgccatgcttgaggcgcatttgaaaaagattgaaaacaaagcagcgcaaatttttgtctactccttaacctcgcaccatcggatcggttatacgagcaggcagcttgctgatacgctgaaagaagacgaatggtatgtctatatcatgttttgggcttcggtacattattttattcattctcttccggagtgtgaagatgctttgttaaaggatctcctttctgatgtgcacttagataatgccctgacagagtcgacgaggaaaacatggcagatggtcaaacaagggtttccgatacagcgaattgctgaaatcagaaagctgaaaacagcgacgattgaagaccacattgtcgagatttctctccatgagcctgcgtttatgattaatgactatgtatcagcagaagaccagcttcaaatcgcagagtttgccaaacggatgcggacgaataaaatcaaacaaattcgcgacgggctggaacagcggttcagctactttcaaatcagactggcattgacaaagcaggtgcagcaatatgactaaattacagcaaacgttatatcagttttttggttttacttcctttaaaaaagggcagcaggacattattgaaagcatactcagcgggaaggataccattgcaatgctcccgactgggggagggaaatcgctttgctaccagctgcctggttatatgcttgacggcatggtattaatcgtttctccactgctttctttaatggaggatcaggtgcagcagctgaaagcccggggggaaaagcgtgctgcagctttgaacagcatgcttaacaggcaggaaagacaatttgttttagaacatattcatcgatataaatttttgtacttgtctcctgaagctttacagtctccatatgtattggaaaaattgaaaagcgtcccgatcagcctatttgttattgacgaagcgcattgtatttctgaatggggacacgacttcaggcctgattattcaaagctcggacagctgagaaaaaaacttggacacccgcccgttctggcattgaccgccacggctacaaaggaaacgctgcaagatgtcatgaacctgctggagctgcagcatgctgtacgccatctcaactcagtcaaccgcccaaacatcgcactgagggttgaaaatgcggcggatactgccgaaaaaatagatagggtcattcagctggttgaaaacctgcaaggtccgggaattgtttattgtccgacacggaaatgggctgaggaattagcgggtgaaattaaaagcaaaacgagcagcagagccgacttttaccatggcggtttggagtcaggggacaggattttaattcagcagcagtttattcataaccagcttgatgtgatatgttgtacgaatgcgtttggaatgggtgtcgataaacccgatatcagatatgtgattcattttcacctcccgcagacggcagaagcttttatgcaggaaatcggcagagcgggccgcgacggaaagccgagtgtcagcattttgctgcgggcgccaggggattttgaattgcaggaacagattatccagatggagagtgtcacagctgaagaaatcgccgacgtgatccgtgtgctagagaagacggaggagcgggatgagagaaggcttcgtgacgtattacttcagtatggcgtcggagagacacaggcccgtatgatgattcatctctttatgcaggggaaaacatcagttgaactgatgaagaaagaaatttcatatcgcatggagctgaagctggaaaaaatgcaccgtgtatcatttttgcttcagcgtgatggctgtttaaggcaggcactattaacctactttgatgaatcatacgagcctgatgacggaaacctcccgtgctgttcacattgcggttttgatttatccttgtatgaacaaaaaggggaacggagtaaaatggcgccattagacagctggagttcggaattgcaccggatattcagcttgcagactgtaggtgagctgaactgaaacagcaaaaagattatattcagcatatgactgaccgtgatatgctgaagcagttatatttgacgcagctactcatcatctttgccgctgctgcagcaggactgttcttttttgaggatgtacgggacgtattaaagctctgggacattcgcgatatgcgaatcatctggtatggtgtttctatagctgttattgttattttagccgatatggcagtaatgaaatggtttccgtctcatttatatgatgacggcggaatcaataaaaaaatattcagtaagaggtcaatccctcatattatatttttaacgcttctgattgctttcgcggaagaaatgttattcagaggagtgctgcagactcatatcggtttatgggcggccagccttatatttgccgctctgcactttcggtatttgtcaaaatggctgttatttattatggtgacagcaatcagctttttgctcggtctgatgtatgaatggaccggcaacttatttgttccgatgacggcgcattttatcattgatgccgtgtttgcctgtcagattcgttttgaacatgtgaggagggataaacatgacgaacatgtcgagagtagagagaagaaaagcccagaatctttatgaagatcaaaacgccgcattggcggacgattatgtcgatgatggagaaagccttccgacaagacaatctgtaaaaaatcaaagagaacagaaaaaaaagcaaggcaaaacaaaaacgccattattcacagtactcgcagtaatatttgtatttgtgccggttattgttttagtcaccttattttatctaaagagccacccggataatcatgacgattatgaagatgtttttattgacagcagccaaagcaaatatgaggttgtcccgaaatcagaggataaaaacgataccgcagacactaaagaaaccgcactgcagaaggagtcaaaaaaagagccagaagattccaagccaaaagagcaaacagctgctgataagaaacagactgctgtagcggaaaaagaagactcggcaaataaggaggaagcaaccgccgcggctgcttcctcttcccaatcaacagtacaacagcaagaacagccagctgagccagttcaaaatgtgccgaatcgcgttgtcaagcacaccgtccaaaagaaagaaacgctataccgcatttccatgaagtattataaaagccggacaggagaagaaaaaattcgagcatataatcatctgaatggaaatgatgtttacaccggacaagttttggacatccctttaatggatgaatagggtattatttttattttacgttcatatattgtagcaatgaaaatggacaaggtgtgaagcgtatggaatccttatggaatcagctggatcagtttacagacgcgccgaccaaacagatgctccaagcgctggtaaaacgaaaacaaaaattcgaaaattatgcagcgcaatgccgcagatggcgatgggcttcacttatctgcctaggcttattatgtgttatgatcatgatcaaaagcccggagcctcagcttatacttcaagaaatacttagccataccttttatttattttggatgctggcaaccgcttttgcctactgcacttcatattatttcaagaaaaaggaagaaaaatccgagactgatttccataaactgagatgtgaaattattcagaaaagcactgatctctggccgcagcccgataaatggaaggcgagagagtctgtttttcatatgatgaagcacaaatatgacattaatctatattttgaaagtaaataaaatggggcgttttctcaaacgatagaaacgtctttttttattgtccgtcttattgataagttctaaaaagaatggagagttttttatgaagctatcagtgaaaattgccggtgtactaactgttgcggcagcggcaatgacggcaaaaatgtatgcaacagcaaaaggcaatcatttgaagacacatacgtttcctttatcaaagatgaagggcaagccgcctctcacaatcttttttatttcagacattcacaaacgtctcatcgatcaagaccttttagaaaaagcgcgaagccatgccccccacttggttataatcggcggtgatttagctgagggcggggtgcccagtgcgagaatcgaggaaaacatcaaaaggctcgtacatttcggggtccctatcgtgtttgtgtgggggaataatgattatgaagtcaggcagcataagctgtattccatatttaaagcgcacggcgtcatcactctgagaaatgagtcagtcccgttttcatacaatgggcatacgattgcgattgcgggggttgatgatatcaggatggagatggatcattatgaggaagccatcaaagaacttgatgaaagccagctgaatattctggtttgccataatccggagattcatgaacaaatcaatgaagatgacggtattgatgtgatactcagcggacatacccatggaggccagatcaggtttggaaaattcggtccttatgaactggggaaaacaggtattgttaaaaacgcggcatatctgatcagcaacggctacggcacgacaaaagtgcctcttcgtttaggtgctgagcctgaaacacacattgtgactctttgcgggccagcataacttctaaaaagcaaaaatccatatggcaataaaaactgcattgtgcttgtcttactagtgaactcagtgtaaactgataacaattaagaacctatgactcatcatctcatataatgtgttatatgatttgtgtgcaagtagaggcaggagggaacgttatgcggcttgagcgtctgaattataataagatcaaaatctttttaaccctcgatgatttgacagaccggggattgacaaaagaagacctctggaaggactcatttaaagtccaccagttatttaaagatatgatgaatgaagcaaatacagagctcggctttgaagcgaatggaccgattgcagtggaagtgtattctctccaagcacaagggatggtcgtgattgtaacaaagaaccaagacgccgattcagaagacgatgagtatgatgatgattacatcgaaatgcaagtcaagcttgatgaaagcgcggacatcatatatcaattccattcctttgaagatatcattcagctttcagaaagcttacagcgaatcggtatcacagggggaactgtctaccactatgacgggcagtactttttaagccttgaagatctagggtcacatacggctgaaggggttgtggcggttctggctgaatacggcaatccgacaactttaacgatttatcgcctgcaagagtatggtaagctcattatggacggtaatgccgtagagacgatacaaactcatttttcataagaatgcaacggaaaactgctgatttcagcagttttttttcgttaaaaaacatggaaaaacataacgtttattctatgcacagatcatatgaaggtgtatactattctctgaaagggagcatgtgagaaacagaagattctaggaggttaactcaaatggcagccgatcgaaacaccggtcatacagaagaggacaaacttgatgtattaaaatcaacccaaaccgtaatacataaggctctggaaaaattgggatatcccgaagaggtatacgaattgttaaaagagccgatgagattattaacggtaaaaatacctgttcgtatggacgacggttcagtaaagatttttacaggatatcgtgcgcagcacaatgactctgtcggtccaacgaaaggcgggatacgttttcacccgaacgtaacagaaaaagaggtgaaggcgctttcaatttggatgagtttaaaatgcggcataattgatcttccatatggcggtggtaaaggcggaattgtttgtgatccaagggatatgtcgtttagagagcttgagcgtctgagcagagggtatgtcagagcgatcagccaaattgtcggcccgacaaaagacgtgccggcaccggatgtatttacaaactcacaaatcatggcttggatgatggatgagtattcaagaattgatgaatttaattcgcctggatttattacaggcaaaccgcttgtgcttggcggatctcacgggagagaatctgcgacagcaaaaggtgttaccatctgtattaaagaagcggctaagaagagaggcatcgatattaaaggtgcgcgtgtcgttgtccaaggcttcggaaacgcgggaagctatttggcaaaatttatgcatgatgcgggggcaaaagttgtcggcatctcagatgcgtatggcggactttatgatccggaaggccttgatatcgattatttactcgaccgacgcgacagcttcggtaccgtaacaaagcttttcaacgataccattaccaaccaagagctgctggagctggattgtgatattctcgttcctgctgcgattgaaaatcaaattacagaagaaaatgcccataatatccgggctaaaattgtcgttgaagcagcgaacggaccaacaacgcttgaaggaacaaagattctttcagaccgggacattctgcttgtaccagacgtgctggcaagtgccggtggcgtaacagtttcttattttgaatgggttcagaataaccaaggcttctactggagtgaagaagaggtagaagaaaaattagaaaaaatgatggtcaaatcatttaacaatatttatgaaatggctaacaaccgaagaattgacatgaggctcgctgcatatatggtcggcgttcgcaaaatggctgaagcttcgcgttttagaggctggatataagttgatgatttgcataaaaataaaaaatctcctatgataaaataggagatttttttattcggaaatagaaaatatgaagtgaaatgccaatcgcaggagttgacagaaatgattcaagaaaaagcaattattataggcggaggaccttgtggactatctgctgccattcacctaaaacaaattggcattgatgccctcgtcatcgaaaaaggcaatgtcgttaacagtatttacaattacccgacgcatcaaacctttttcagttcaagtgaaaagctcgaaatcggagatgtggcatttattacagagaacaggaagcctgtcagaattcaggctttatcgtattaccgggaagtcgttaaacggaaaaacatccgtgttaatgcgtttgaaatggtgcgtaaagtgacgaaaacgcaaaataacacattcgttattgagacgtcaaaagagacctacacgacgccatattgtatcatcgccacaggctattatgatcatccaaactatatgggcgtacccggtgaggatttgccgaaagtatttcattattttaaagaaggccacccgtattttgataaagatgttgttgtcatcggcgggaaaaattcaagcgtggacgccgcccttgaactcgtgaaatctggggcgcgtgtcacagttttatataggggcaatgagtattctccaagcattaagccgtggattctgccagaatttgaagccctcgtcagaaacggtacaatccgtatggaatttggcgcttgtgtcgaaaaaatcaccgagaatgaagttgtgtttcgctccggagagaaagaactcattgccattaaaaatgattttgtatttgccatgacaggctatcatcccgatcatcaatttcttgaaaaagttggtgttgaaattgataaagaaacagggcgtccatttttcaacgaagaaacgatggaaacgaacgttgaaggtgtctttattgccggtgttattgctgcgggaaacaatgcaaatgaaatatttattgaaaacggcaggtttcacggggggcatattgcagcggaaatcgccaaaagagaaaaccattaaagatgaggagcatatgatgcattcgtatgctctttttgtttttttaagtgcagacagatgtaaaattttaaacaacatggtaggatagacgtaggaatataaaggaaagaggttgcctgatgtttgcaatcatctctgcaggaattgcccccggcatcgcgttattaagttatttttatttaaaagatcagtatgataatgaacctgtacatatggtgctacggtcgttttttctcggggttgttcttgtatttcccataatgtttatccagtatgtacttgaaaaagagaatgtaggaggcggaagctttttcgtttcttttttatcttcggggtttttggaggaatcattaaaatggtttatactgatgatcagtgtttacccgcacgcccactttgatgagcattatgatgggattgtgtacggtacaagtgtatcactcggttttgcaaccctcgaaaatattctttatttaattggccacggcgtggagcatgcgtttgtcagggcgctgctgcctgtttcatgccatgccttgattggcgttataatgggattttaccttggaaaagcccgtttttccgctgataaggcgcgtgtaaagtggcttactctttctttagttgtcccatcccttttgcatggatcatatgattttatcctaacagcgcttagcaattggatttattatatgcttccatttatggtatttttatggtggtttggtttgcgtaaagcgaaaaaagcccgttccgttaatatgatgcaagtatagaagccgcacagcaaccgtgcggcttttttgtgtgcagtttttatgttctgagggataacaaggaaagagtgtataaaaataacctcgttacagaaaatacgattacacttaaaaatttgcagtaggaggcttgaaaagatgaagtccaaaggatcgattatggcatgtctcatccttttttcctttacaataacgacgtttattaatactgaaacgatctctgccttttcgaatcaggtcattcaaagaggggcaaccggggatgatgtggtcgagcttcaggcgcgtcttcaatacaacggatattataacggaaaaattgacggggtttatggatgggggacgtactgggcagttcgaaattttcaggatcaattcgggttaaaagaggttgacggccttgtaggagctaaaacaaagcaaaccttaatatgtaaatcaaaatactatcgtgaatatgtcatggaacagctcaataaagggaatacattcacgcattacggaaaaattccgctaaagtatcagacgaaaccatcaaaagcagcaacacaaaaggcaagacaacaagcagaagcacggcagaaacagcctgcggaaaaaacaacgcagcagcctaaagcgaatgcgaataaacagcaaaacaatacaccagcaaaagcaagaaaacaggatgcggtagcagcgaacatgcctggtggattttccaacaacgatatcaggctgcttgctcaagcggtttatggcgaagcccggggcgagccgtacgaggggcaggttgctattgcagcagtcattttaaaccgtttgaacagcccgttatttccaaattcagtagcgggggttatttttgagccgcttgccttcacagcagtagccgacggacaaatttacatgcagccgaatgaaacggcacgagaagcagtgctggatgccatcaatggctgggacccatcagaggaagcactttactactttaatccggatacggctacaagtccgtggatttgggggcgtccgcagattaaaagaatcggtaaacacattttctgtgagtagcagatatgagaaagcataaaaagaggtgtgataaatgatcagaggaattttaatcgccgtgcttggtattgcaatagtcggtacaggctactggggatacaaagaacaccaggaaaaagacgcagttcttcttcatgctgaaaataactatcagcgggcgtttcatgagcttacctatcaggtggatcagcttcatgataaaatcggaacaacacttgccatgaacagccaaaaatcactgtcgcctgcattgatcgatgtgtggaggattacatcagaagctcataacagtgtcagtcagctgccgcttacattaatgccgtttaataaaactgaagagctattatcaaagatcggcgatttcagctataaaacgtcagtcagagatttggaccaaaagccgcttgataaaaacgagtatacatcactaaataagctatatcagcagtccgaagatatacaaaatgaattgcgccatgttcagcaccttgtcatgagcaaaaaccttcgctggatggacgtagaaatggctctggcttctgacgaaaaacaaagtgataatacgattatcaacagctttaaaacagtcgaaaaaaatgttggtgcattctccaccggcactgatcttggcccgagtttcaccagtacgaaaaaagaagagaaaggcttcagccatctgaagggaaaacaaatttccgaacaggaagcaaaacaaattgctgagcgctttgccccagatgacaattattcaattaaagtggtaaagagcggaaaaaaaacaaatcgcgatgtatatagcatcagcatgaaagacccagaccataaagcagtgatttatatggatattacgaagaagggcgggcatccggtatacttgatccaaaacagagaagtgaaagatcagaaaatcagtttaaatgacggatcgaaccgagcgcttgcatttttaaagaaaaacggatttgaaacagatgatttggaaattgatgaaagtgcccaatatgataaaatcggtgtattttcatatgttcctgttgaaaataaagtccggatgtacccggaggcaattcgtatgaaagtggccttggatgacggtgaggttgtcggcttttcagcaagagacttcctcacatctcacagaaaaagaaccatacctaagcctgcaattactgaagcagaggcaaagtctaaattaaataaaaatgtacaagtgagagaaacaaggctcgctttgattacaaatgaactaggtcaagaagtgttatgttacgaaatgcttggaacaattgaaaatgacacattcagaatgtatatcaatgccaaagacggatcggaagaaaaggttgaaaaactaaaaaatgcagaacctatatataaagacctataaaaacaggaggaaaggactaaatgtcttttcctttttttcattacgtgctttaataaaaacgtgagtatattgaatgcgaaagagtgaagtcaatgatagagattggagaaaatgtacttttagaatatatagaagaaaatgaattgaaaaaggcaaaaagcaaggcggtcagcatcgaaaacaatgaacttttgatcgcgtatcctgttgatgtagttacagggcgaactgtgattttacataacgatatggaagtaacggtagagtttgtgggaaaagacgaagttccttatcgctttataagccgtataaaaggtaaagtgaaggacaaacttcaaatgatctgtcttgaaatgcctccccgtgaaaaaatgaaaagaatccagcgccgccaatatgtaagaactgatgcggtattagatgtgcaaattcagccgggaaatgaagaagagatccgcacactatcttataacatcagtgcaggcggcatcgccgtggttttagctgatggcctttcttttcaatcgggggaatcattgcgcctggtcatccgtcttcctgaagaggagcacacacgtcaaatagaaacagaagcagttgtcagacgaatctttaatgaccccaagtcagaaaaacgaaaaatgactttagagtattcagaaattgcagcaggtgaccagcaggctttgcttcaatactgcatccggcgccagttaaataagagaagaaaggcccgaatggaataaacatcggcaaacacttccatactatttgtaatggaggtgctccaatgaaaacatttgaacggctgctgatcaaattattgttcattcaggccatcattttacttggtgtccaatttctttttcactatcagcatattgaaccatacgtatcaaaagtgattcaatatgaaggggtggataaaatggaggaaaacaataggattgaaaccttcaaacattaattattcatcaatttttcaccctttttcataaagttcgtgatacaatccatagaggagaaaagagcaaggagaggaattatggaaaagaaattatcgattgcaatcgacggcccggcagctgcggggaaaagcaccgttgccaaaattgtggctgagaaaaaatcgtacatatatattgatacaggagcgatgtatcgggcgattacgtacgcggctttacaggaaaacgttgatctgacagatgaagaaaaactggctgagctgctaaagcggacagacattgagctgattacaacaaaagatggacaaaaagtgcttgtaaacggcaccgatgtaactgaggcgatcagaacagatgaagtcagcaaccaagtttcaattgcggccaagcacagaagtgtcagagaagaaatggtgaaacgccagcagcagcttggggaaaaaggcggcgtcgtcatggatggtcgtgacatcgggacgcatgtgctgccaaatgcagaagtaaaaatctttcttttggcatctgttgaagagagagcgaaacgccgttatgaagaaaatgtgaaaaaaggctttgatgtcaacttcgaaacattaattgaggaaattgcaagaagagacaagcttgattcagagcgcgaagtatctccgctgcgtaaagcagaagacgctcttgaaatcgacacgacatcgctttccattcaagaggtagctgataaaatcctcgaggctgtggagcaaaagtcccgctgaggatggcaaatgccactttttttgaatttttcaacgaagatagaatgttattgcttgacaaacctgtccttttattagaagttaatactaataaaactttttattgatcattcaaaaaacttttttggatgattctttaatacatattcggctaaaagcgggcatgttatatgttcagctttcaaaccgttttaattaagctgtgtaggtttggaccaaggaggttattcaaatgacagaggaaatgaatcaaattgatgttcaagtgccagaggttggagatgtagttaaagggattgtgacaaaggtagaagacaaacatgtagatgtagaaattatcaatgttaaacaatccggtattattccaatcagtgaattatcaagtcttcatgtagagaaagcatcggatgttgttaaagtagacgacgagcttgacctgaaagtaacaaaagtggaagacgatgctttgattttatctaaacgtgctgttgatgcagaccgcgcttgggaagaccttgagaaaaaatttgaaacaaaagaagtgtttgaagctgaagtgaaagatgtcgtgaaaggcggccttgtcgttgatatcggcgttcgcggttttattccggcatcacttgttgaagcacatttcgttgaagacttcactgactataaaggaaaaacactgtcactgctcgttgtagagcttgaccgtgataaaaaccgcgtgatcctttcacaccgtgctgttgttgaaagtgaacaagcgaataaaaaacaagaacttcttcagtctcttgaagttggaagtgtacttgatggcaaagtacagcgcctgactgattttggcgcgtttgttgatattggcggcatcgacggacttgtacacatttcacagctttcccactctcatgtagagaagccgtctgacgttgttgaagagggacaagaagtaaaagtgaaagtgttatcggttgaccgtgataatgaacgtatttctttatcaatcaaagatacactgcctggaccttggagccaaatcggcgaaaaagtgaagcctggcgatgtgcttgaaggaactgtacagcgtcttgttagcttcggtgcctttgttgaaatccttccaggtgttgaaggtctcgttcatatttctcaaatttccaataaacacatcggcacgccgcatgaagtccttgaagaaggacagactgtaaaagtgaaggttcttgatgtgaatgaaaatgaggagcgcatttcattaagcatgcgtgaacttgaagaaacgcctaaagctgaccaggaagattaccgtcaatatcaagcgaaggaagaaacaagcactggcttccagcttggagatctgatcggagataagctgaataaactaaaataattggtgataaacgtgactcgagcagaacgaaaaagacaacacatcaatcatgccttgtctaccggccagaagcgggaaacaggtcttgatgatattacgtttgttcacgtcagtctgcccgatcttgcattagaacaagtagatatttccacaaaaatcggcgaactttcaagcagttcgccgatttttatcaatgcaatgactggcggcggcggaaaacttacatatgagattaataaatcgcttgcgcgagcggcttctcaggctggaattccccttgctgtgggatcgcaaatgtcagcattaaaagatccatcagagcgtctttcctatgaaattgttcgaaaggaaaacccaaacgggctgatttttgccaacctgggaagcgaggcaacggctgctcaggcaaaggaagccgttgagatgattggagcaaacgcactgcagatccacctcaatgtgattcaggaaattgtgatgcctgaaggagacagaagctttagcggcgcactggaacgtattgaacaaatttgcagtcatgtcagtgtaccggtcattgtgaaagaagtcggattcggtatgagcaaagcatcagcagggaagctgtatgaagctggtgctgcagctgttgacattggcggttacgggggaacaaatttctcgaaaatcgaaaatctccgaagacagcggcaaatctccttttttaattcgtggggcatttcgacagctgcaagtttggcggaaatccgctctgagtttcctgcaagcaccatgatcgcctctggcggtctgcaagatgcgcttgacgtggcaaaggcaattgcgctgggggcctcttgcaccggaatggcagggcattttttaaaagcgctgactgacagcggtgaggaaggactgcttgaggagattcagctgatccttgaggaattaaagttgattatgaccgtgctgggtgccagaacaattgccgatttacaaaaggcgccccttgtgatcaaaggtgaaacccatcattggctcacagagagaggggtcaatacatcaagctatagtgtgcgataaatgataaaagcccaaaaccatatgtggtttgggctttttgtattatgattttcgctttttgaatcttccgttttgttcaaggcttgtcgctccgtcatagtgaatggactggtcgcggtctgattcgactctgcctgaagctttgagttttttctcttgtctgtcttttcccatgatcatactccttagtgagatcgattgtttaaaaaatgtgcttgaactccatactgggaatatggaggaagtaaaatggaacaattttattactattggtcaatgtggtttctgtgggttctgacaacatttatttttgaaaagacgaaaagacgaattgccgtctctgtctttattttaactaatattattctaagcatacatgacatcgctttatatttttccctgaatgctgcatatttgatgtttttcgtttgcggatgtgtctatgccgggtatttgggaatgtatcgttttcgttacatcatggtctatctgacgcttgttgccgcgtatgcgtttgtttatctttttgcattatatgacccggtttggttcatcataaaacctgagtgggctgctgttatattaatagtgcttttaacagcttctgttgaaaggaattttgagaagcagcttgtcttatttgtcctagggatgtgccaaggcgaactggtgtattcatttgtgatccagaagttggccggggctatggctgtcggcggctttcaatggctgaatgcgtgttctgcggggatgatattgctgtttggcatatctaaatacgaatacctcgcaagccagattggtcagaaaagcaaaagatcaaacaaaggagctaccaaaatgtcatgagtgattacatctatccgattattgctggggtcattgccggaattgcgacaaggctttatatgctgaaaacggattaccgccagtatccgacctatgttcatgggaaagtgattcacatcgcactggggttgatagcggctggtttaggtgcaattattatgccggcgcttttgcaggaggaatttacggccatcacatttttaacattggcagcgacgcaatttagagatgtccgaaacatggagcggaacacattgacgcaaatggattcgtatgaacttgtctcaaggggaagcacatatattgaggggattgccattgcgtttgaaagcagaaattatattgtgatctttacagcgcttttgacaacctctgcgtatgtgtttttatccatctgggctgcagtcatagcggctgtcgtttgttttttactggccatgaagtttatgtcgggcagtgtgttgaaggatattgtagatatcgagtacataaagccgcgctttgacggtccgggactgtttgttgataatatttatatgatgaatatcgggcttccagagaaacaggaactgattttaaagcatggcatgggctttattttgacgccgaaaaactttaattcagcagcgacgatagcaaatttagggcagcgtcaggccattttatttgatgtttccaatgtgctcggggtttatcgggattcaggagagccatctttgacaccaattgcaaaacgggatttaaatgatgggagagtggcagtatttgttctcccgcaaattcaccatcccgaaacggctgttcaaattattagcaatgttccaaccctggaaaatgcgattagaatgccgactgaatttatcaagaatcaggataaggtgataggatgagtgaatctcttacgaaagtgattttgtctgtaatcacgacaaatcgaaaccgggttgcagggggagcacctgtctttttttgcaatgaccaaaaggagatggagcttttcgctaaaaatcttgaggcgatccttgatggaatagctcacagaatcggagatgacgtgtatttgatcgtgaaacatttttaagaatagttgtgatcccagtaaaaactgatataataaatgagttaagcccttcctctgaagggtttcttttcataaaagtgaatgaaatgattttaataaccggttgaaaatttatgtaaaaatgaaagcggctggattgaaaggaagggtactatgggtaaacctgtcgtagccattgtcgggagaccaaatgtaggaaaatccacaatctttaaccggattgcgggagaaagaatttcaatagtagaagatacccctggcgtgacaagggatcggatatacagctcggctgaatggctgaattatgattttaatttgattgatacgggcggtattgatatcggtgatgagccgttcttagcgcagattcgccagcaggctgaaatcgccatggatgaagcggacgtgattatttttatggtgaacggccgtgaaggtgtgacagctgctgatgaagaagtggcgaaaattttgtaccgcacaaaaaagcctgttgttttagcagttaataaactggataacacagaaatgagagcgaatatttatgatttttattcgctaggctttggcgagccatatccaatttcgggaacacacggactcggactgggtgatttactggatgccgttgcagagcattttaaaaacattcctgaaacgaaatacaatgaagaagttattcaattctgtctgatcggacgtccaaatgtcggaaagtcctcacttgtgaatgcgatgctcggcgaagaacgcgttattgtcagcaacgtggctggaacgacaagagatgctgttgatacgtcgtttacttacaaccagcaggagtttgtcattgtcgatactgcaggtatgcgaaaaaaagggaaagtctatgaaacgactgagaagtatagtgtactgcgggcgctaaaagcgattgaccgctcagaagtcgtggcggttgtgctggatggcgaagaaggcattattgaacaggacaagcgtatcgccggttatgcacacgaagcgggcaaggccgtcgtaatcgtcgtaaacaaatgggatgctgttgacaaagatgagagcacaatgaaagaatttgaagaaaatattcgcgatcattttcaatttctggattatgcgccaatcctatttatgtctgccttaacgaaaaaacggatccatacgctgatgcctgcgattatcaaagcaagtgaaaatcattcacttcgagttcaaacaaacgtcttaaatgatgtcatcatggatgctgtggcaatgaatccgacaccgactcataacggttctcgtttgaagatttactatgcgactcaagtgtcggtaaagccgccaagcttcgttgtgtttgtaaacgatccggaattgatgcatttttcatacgaacggtttttagaaaaccgaatcagagacgcgttcggttttgaggggacaccaatcaaaatatttgcaagagctagaaaataaaaaggtgtgaagcaaatatgaaaaaagtcacaatgctcggagcggggagctggggaacagcactggctttagtgttagctgataatcatcacgatgtaaccatgtgggggcaccgtgcagatctgatccatcaaatcaatgatcagcatgaaaataaagattatttgccgaacgtcaagcttccagaatcaatagaggcaacaacggatatgaagacagctgtttcagacgcagatttcattatcgttgcggtcccgacaaaagcaattcgggaagtgctgagacaggctgtcccttttataacgaaaaaggcagtctttgttcatgtcagcaagggtattgagccagattcacttctgcgcatttctgaaattatggaaattgagctcccgagtgatgtcagaaaagatatcgttatcctttccggcccgagtcatgcggaagaagtagggctgcggcaccccacaactgttactgcatcttcaaagagcatgagggcagcagaagaggtgcaggatctatttattaatcacaattttcgggtgtacacaaatcctgacattatcggagttgaaatcggaggggctttaaaaaatattattgcccttgctgcaggaattacagatggtttagggtacggcgacaatgccaaagctgctttgattacacgcggacttgccgaaatcgcgagactcggaacgaaaatgggcggaaatcccttgacgttctctggattgacaggagtaggcgatctgattgtgacgtgcacaagtgttcattccagaaactggcgtgcgggcaatttgctcggaaaagggtacaagcttgaagatgttcttgaagagatgggaatggtagtcgaaggcgtccgcacgacgaaagcggcttaccagctttcgaagaaatatgatgttaaaatgccgattacagaagctctccatcaggtcctattcaacggacaaaaagtggaaaccgctgttgaatctttaatggcgagagggaaaacccacgagatggaggatttggtaaatacgtttgaaaatcaagtgaagtaaaagtgtcaatcaaatgatggatcgcatatcttaattgaacgaaagcccgaaaaacagaagaacacccaagtcttgggatctcctgaaacattttgccgatttaggcaatagaggatgcatctgtatgtcatgtcgcatactatagcatcgaagtccaagagagtgtttcttaaacgtgcaggtgaatatagtcaagttgactgaagcgaaggtccccctctttgcttcagtttttttgttctatcaaaggatggaaaatctggttgatcttttccggcgctgtatattaaaatataatataacgcttacatcatacatatcggggaggcgcacgtcattgaatctggcattgatgaaaatgtggtttgctctagggtccatgggtctgatgtttctggctgtagcttccatctatttaagccgctttaagtgccaaaaccgttttttgaagattgcgatttcatcattcgcatacatgtgtatgctcatatctggaattattgtgtttgtcgtggtttttagcggccctgtcaatgaataaagctgtaaaaggaagtgctgtatgggtaaactgaaatgcgcaatcatttttgcggcagtcgtgtttttatccggatgtttatatccaaatgaacggaaaagcagtgtgcaagccattccttatcaagaccagctaaagcaggttcaatctgctgttgatgaatttcaaaaggcaaatggagggctgcttcccattcaaacaaaagatatgtcgacaccgctatatcaaaaatatccgatagactttaaccggttagcgccaagatacatagctgaacctccaagtacggcatttgaaagcgggggagactatcaatacgtgcttgttgacgtagagaacgatccgactgttaaattaattgatctaaagatggcagaaaaaattcgcgatgtgaaattgcgcatccaaatgtatcgtcaggagcatcaatatccgccttacaaggatgtgctatctcgcgatttatttacactcgatgagaagaagcttggggatggaagctctcttacagtgacaagcccaatctcagggaattccttgccgcttatgattgacggagacggagaaatatatgctgattaccggactgagctggcttcttgcctcaaaaaaagcaagaaaacgtttaaacccgggactgaaattcaggatatgatttggcaggaaaccccttttgtccccgcgttttctgtaaaatatacggtaaatgacaaacaggaacctgtttttttagaaaatgatatgaaaaaggaatgaacctttctcccttgcatacaaatagggagaaaggtttttttatactttaatagattgaggatgagaaattttctaaagatgtcatattcaaataggacaacgtcatacacatatagtgtcctgtgtttgattgaaagagcttaataaaattgaaaaggataggaagtccgggaggggatcacttggaaaaggtcgatattttcaaggatatcgctgaacgaacaggaggcgatatatacttaggagtcgtaggtgctgtccgtacaggaaaatccacgttcattaaaaaatttatggagcttgtggtgctcccgaatatcagtaacgaagcagaccgggcccgagcgcaggatgaactgccgcagagcgcagccggcaaaaccattatgactacagagcctaaatttgttccgaatcaggcgatgtctgttcatgtgtcagacggactcgatgtgaatataagattagtagattgtgtaggttacacagtgcccggcgctaaaggatatgaagatgaaaacgggccgcggatgatcaatacgccttggtacgaagaaccgatcccatttcatgaggctgctgaaatcggcactcgaaaagtcattcaagaacactcgaccatcggagttgtcattacgacagacggcaccattggagatatcgccagaagtgactatatagaggctgaagaaagggtcattgaagagctgaaagaggttggcaaaccttttattatggtcatcaactcagtcaggccgtatcacccggaaacggaagccatgcgccaggatttaagcgaaaaatatgatatcccggtattggcaatgagtgtagagagcatgcgggaatcagatgtgctgagtgtgctcagagaggccctctacgagtttccggtgctagaagtgaatgtcaatctcccaagctgggtaatggtgctgaaagaaaaccattggctgcgtgaaagctatcaggagtccgtgaaggaaacggttaaggatattaaacggctccgggacgtagacagggttgtcggccaattcagcgagtttgaattcattgaaagtgccggattagccggaattgagctgggccaaggggtggcagaaattgatttgtacgcgcctgatcatctatatgatcaaatcctaaaagaagttgtgggcgtcgaaatcagaggaagagaccatctgcttgagctcatgcaagacttcgcccatgcgaaaacagaatatgatcaagtgtctgatgccttaaaaatggtcaaacagacgggatacggcattgcagcgcctgctttagctgatatgagtctcgatgagccggaaattataaggcagggctcgcgattcggtgtgaggctgaaagctgtcgctccgtcgatccatatgatcaaagtcgatgtcgaaagcgaattcgccccgattatcggaacggaaaaacaaagtgaagagcttgtacgctatttaatgcaggactttgaggatgatccgctctccatctggaattccgatatcttcggaaggtcgctgagctcaattgtgagagaagggattcaggcaaagctgtcattaatgcctgaaaacgcacggtataaattaaaagaaacattagaaagaatcataaacgaaggctctggcggcttaatcgccatcatcctgtaataccggtagacctctttatagaatgggaggtcttttttctttgctcttaataatggaaaaggatcaaggaataggatgaaaaaaggaaaaaaaggaatatttgttcggtaaatcaccttaaatccttgacgagcaagggattgacgctttaaaatgcttgatatggctttttatatgtgttactctacatacagaaattcttcactttgttggacaaacattcctcagagtgcagtttttcttaaaaagccgtttaattgtctttctcttacttgctctcatttttttctgagacaggtttagaatcagactgaactgtgaagaaatgataataaacgaactgaatgtatccttttgggaggaggtgaaaggcatgaacaaaacagaacttatcaatgcggttgcagaagcaagcgaattgtctaaaaaagacgctacaaaagcagttgactctgtttttgatacgatcttagatgcacttaaaaacggtgataaaatccaactgatcggttttggtaacttcgaggtgcgtgaacgttctgcacgtaaaggacgcaatcctcaaacaggtgaagaaatcgaaattccagcaagcaaagtacctgctttcaaaccaggtaaagcgcttaaagacgcagttgccggaaaataattgtgaatatagatcgtgtatgcatctagcttacatacactttatttcttcacagaaaagcccctttctaaggggcttttcatatttcaagagcatgggcttcctgacagggcattcactttgcttttagcggggcatatgtgctagaatcgaaattaaatgtattcattggtggaggacatagaacatgaaagaagttaataaagagcaaatcgaacaagctgttcgtcaaattttagaagcgatcggagaagacccgaatagagaagggcttcttgatactccgaaaagagtcgcaaagatgtatgccgaagtattctccggcttgaatgaagatccaaaagaacatttccagactatcttcggtgaaaaccatgaggagcttgttcttgtaaaagatatcgcgtttcattctatgtgtgagcatcaccttgttcccttttatggaaaagcacatgttgcatatatcccgcgaggcggaaaggtcacaggactcagcaaactggcacgtgccgttgaagccgttgcaaagcgcccgcagcttcaggaacgcatcacttctacaattgcagaaagcatcgtagaaacgcttgatccgcatggcgtaatggtagtggttgaagcggaacacatgtgcatgacgatgcgcggtgtaagaaaaccgggtgcgaaaactgtgacttcagcagtcagaggcgtttttaaagatgatgccgctgcccgtgcagaagtattggaacatattaaacgccaggactaataaagatagagggtgctataaatgaaccaaaagcattcaagtgattttgtcgtcattaaagccgttgaggacggagtgaatgtgatcggcctgacaagaggaacagacacaaagtttcaccattccgaaaaactcgacaagggagaagtgatcatcgctcagtttacagagcatacttctgccattaaagtcagaggagaggcactgattcaaaccgcgtacggagaaatgaaaagcgaaaaaaaataagctggctgtccccgctgttaaaagcaaatgctcgcaaacagcgggaggatacagccaatttcttttttttatgctataatgatacctgcgtaagcgaatgaaaagataaaactcatacatagattaagaaataaatgtgaatttggggacaagggtgatatttttgcaagacatctacggaactttagccaatctgaacacgaaattaaaacaaaagctgtctcatccttatttagcgaagcatatttccgcgccgaaaattgatgaggataagcttcttctttttcatgctttatttgaagaagctgacataaaaaacaacgacagagaaaattatattgtaacagcgatgcttgtacaaagcgcccttgatacccatgatgaagtgacgacagctagagtcataaaacgagacgaaaacaaaaaccgccaattgactgttctcgcgggcgattatttcagcgggctgtactactctttactatctgaaatgaaggatatctacatgattcggacgcttgctacagccattaaagaaatcaacgaacataaaattcgtctgtatgaccgttctttcaaggacgaaaacgattttttcgaaagtgtcggcatcgttgaatcagctttattccatcgtgtggcggaacacttcaaccttccgcgttggaaaaagctgtcgagtgatttttttgtatttaagcggcttatgaacggaaatgatgcatttctggatgtgatcggcagttttatacagctgggaaaaacaaaagaagagatattagaagattgttttaaaaaagcgaaaaacagcattgagtcacttctgcctctaaattcacctattcagaacattttaataaaccgtctgaagacaatcagccaagatcaaacctatcatcagaaagtggaagaagggtaaaccattatgcaggactcaaaagaacagcgcgtacacggagtatttgaaaaaatatataaaaattatgaccaaatgaactctgtcatcagttttcagcagcataaaaaatggcgcgacaaaacgatgcgcatcatgaatgtaaaagaaggcgcaaaagcacttgatgtctgctgcggaacggctgactggacgatcgctcttgcaaaagcggttggcaaaagcggcgagatcaagggcttggatttcagtgaaaatatgctgagtgtcggcgagcagaaagtaaaagacggcggattcagccaaattgaactgctgcacggaaatgcgatggagcttccttttgatgatgatacatttgattatgtcaccattggcttcggactccgcaatgtccctgattacttgactgtactgaaagagatgagacgtgtagtgaagccgggcgggcaggtggtatgtctggaaacgtcccagccggaaatgttcggattcagacaggcttactttatgtactttaagtatattatgccgtttttcgggaaactgtttgcgaagagctataaagaatattcttggcttcaagaatcagccagagatttccctggaatgaaggaactggcaggcctgtttgaagaggcgggcctgaaaaatgttaaatatcattcgtttactggcggagtcgctgccacgcatatcggatggaaatgaaaacacagatgtttgggtgaatgatatgaaatttaaaatggcctactcttttttaaatgacgatattgatgtaatcgaaagagaacttgaacaaaccgtacgttccgattacccgcttttaagcgaggcaggtcttcacctgctgcaggccggagggaaacgtattcggcctgttttcgtgctgctttctggcatgtttggcgattacgatattaataagattaaatatgtcgccgtcactctggaaatgattcacatggcatctttggttcatgatgatgtcattgatgatgcggagcttcgccgaggaaaaccgacaatcaaagcaaagtgggacaatcgtattgcgatgtacacaggcgattatatgcttgcgggatctcttgaaatgatgacgagaattaacgaaccgaaagcccataggattttgtcacagacgatcgttgaagtttgtctaggggaaattgagcagatcaaagacaaatacaacatggaacaaaatctcagaacgtatctccggcgtatcaaaagaaaaacggctctcttgatcgcggtcagctgccagcttggtgctattgcgtctggagctgatgagaagattcataaggcattgtactggtttgggtattacgtcggcatgtcttatcagattattgatgatattcttgattttacttcaactgaagaagagctgggtaaacccgttggaggagatttgcttcaaggaaacgtcacattgccagtgctgtatgccctgaaaaatcctgcattaaaaaaccagcttaaattgattaacagtgagacaacgcaggaacagcttgaaccaatcattgaagaaatcaaaaaaacagatgcaattgaagcatctatggcagtaagcgaaatgtatctgcagaaagcttttcagaaattaaacacgcttcctcgagggcgcgcacgctcatctcttgcagccatcgcaaaatatatcggtaaaagaaaattttaatttttttgtagatattaagaaatttctccgccccggattgattaattatcagaaagatgttacgatttcggtgtgcagtgtgaaagcctatacatacataatgatggggtggagaatatgatggaaaagacttttatcatggtgaaaccagacggtgtccaacgtcagctcattggggacattttatctagattcgaacgtaagggcttacaattagctggcgccaagttaatgagagtgactgaacaaatggctgagaaacactacgccgaacatcaaggaaagcctttcttcggagagctcgttgagtttattacttcaggacctgtattcgcaatggtgtgggaaggcgaaaatgtcattgaagtgacgagacagctgatcggaaaaacaaaccctaaagaagctttacctggtacgattcgtggggattatggcatgtttgtcggaaaaaacatcatccacggctctgattctctcgaaagtgcagaacgcgagattaacattttctttaagaatgaagaattagtatcatatcagcagcttatggcaggctggatctattaatcattgtgaaaataagcaacagagccggcatcatataacgccgccggtttttgatctgttttgtaaaggtttacattaaagtgaataaagtgttgattggcagtgtgcatcagacctctgcctttcccaacgatctaaaatcagctgaaaagctgatttttttattgaaacaatacaatttcctgataaaacaagctatactaggacaaaaagacagcgagactgggagagtagagatggatacatacagcgtatttacaacgaaatggaaacaattaaccggagtcgatttgacactatataaagaagcacaaatgaagagaaggctaacgtcactttatgagaaaaaggggttccaaagctttaaggactttgctgcggcattggaaaaggatcaagctctcttaaatgaaacattggacagaatgacgatcaatgtttcagaattttatcgtaattataaaagatgggaagttcttgagactgcaattctgccgttaatcaagacctctaggcctttaaaaatttggagtgccgcctgctcaacgggggaggagccatacacgcttgccatgcttttggaccagcaaaaaggtcttccgggctatcagattttagcgacggatattgatgaaaaagcattggaaaaagcgaaaaaaggcgtttatcaggagcggtctttacaggaagtgccgctatctgtgaaagatcgttattttacgcaaaacgcaaatagaagttatgaagtgaaaacggaaatcaaacagaatattacattcaaaaagcacaatttgctggcggatcgttatgaacaagactttgacttaatcgtgtgccgcaatgtatttatttattttacagaaagcgcgaaggaagagctgtatttaaaaatggcacatagcttgaagaagaatggagttctttttgtcggcagcaccgagcaaatcttcaatcccgagaaatttggcctagtcccagccgatacattcttttatcaaaaaagatagactgactttttgctgaaaaatatgttatagtagtcttacttaaaagcgttaatgcgatgaagggagaagaagtcatgagatatttaacagccggagaatcacacggcccccaactgacaaccattattgagggtgtacctgccgggctttacataacggaggaagatatcaattttgagcttgccagacgccaaaaaggacacggccgcggccgccgcatgcagatcgaaaaagaccaggccaaaattatgagcggggtgcgccatgcacgtacactcggttcaccaattgctctcgtagttgaaaataacgattggaagcattggacaaaaatcatgggcgccgctccaattacagaagatgaagaaaaggaaatgaagcgccagatttccagacctagacctgggcacgctgacttaaacggtgcaattaaatataatcatcgtgatatgagaaatgtgcttgagcgttcttcagcaagggaaacaactgtcagagtggcggcaggggctgtagctaaaaagattctttctgagcttggcattaaggtggcgggccacgtgttgcaaattggcgctgttaaagctgaaaaaacagaatatacgtcaattgaagacctgcagcgcgtaacggaagagtctcctgtcagatgctacgatgaagaggcaggcaaaaaaatgatggctgccattgatgaagcaaaggcaaacggagattccatcggcggaatagtagaagtcattgtcgagggaatgccggtaggcgtgggcagctatgtccattatgaccgcaaactggatagcaagcttgctgccgctgtactgtcaattaatgcatttaaaggtgtggaattcgggatcggatttgaggcggcaggccgaaatggaagcgaagtccatgacgagatcatttgggacgaggaaaaaggatacacccgtgctactaacagacttggcggactggaaggcggcatgacgacagggatgccaatcgttgtccgcggagtcatgaagccgattccgactttgtataaaccgctgaaaagtgtagatattgaaacgaaagaaccgttttccgccagcattgaacgttcagacagctgtgctgttcctgcagcaagtgtagtcgctgaagcggctgtcgcttgggaaattgcgaacgcagtcgttgaacaattcggattagatcaaattgaccgcattagagaaaatgtggagaatatgagaaaactgtcgagggaattttaatgaagacactgcatgttcaaactgcttcctcgtcatatcctgtttttatcggacaaggtatcagaaaaaaggcttgcgaactattaacctctttaaacaggcctttaacaaggattatgcttgtcacggatgaagaggtggaccgcctgtatggtgatgaaatgctccatttgctgcaagataaatggcctgtgaaaaaagtgacggtaccgagtggagagcaggcaaaatccatggacatgtacacaaaattgcagagtgaagcgattcgttttcatttggatcgctcctcatgcatcatcgcattcggtggcggtgttgtaggggatcttgccggttttgtggctgccacttttatgcgcggcattgatttcatccaaatgcctacgacgctcttggcgcatgacagcgcagtcggaggaaaagtagccgtgaaccatccgcttggaaaaaatctaatcggtgcgttttatcagccgaaagccgtgctctatgatacagatttcctgcgttctctgcctgaaaaagagcttaggtccggaatggcagaagtgattaaacacgcttttatctatgacagagcgtttctggaggagctgctgaatatccactcactgcgtgatatcactaatgatcagctgaatgacatgatttttaaaggcatttcaattaaagcgtctgtcgttcagcaggatgaaaaagaagaggggataagagcttacttaaacttcgggcatacgctcggtcatgccgttgaggcggaatatggatacgggcagatcactcacggtgatgccgtagccctcggaatgcagtttgctttatatataagcgaaaagactgtaggctgtgaaatggacagaaaacgtttggtcagctggctaaaaagcctgggttatccaagtcaaatcagaaaagagacggaaacttcggttctcttggaccgtatgatgaatgataagaaaacccgcggcgggaagattcagtttattgtgctcaacgaattagggaaagttgctgatcatacattttccagaaatgaacttgagagctggctgaacaaatggcgattggaggagacatcatgatgattcgcggaattcgcggagcaactacagttgaacgggatactgaagaagaaattttacaaaaaactaaacagctgttagagaaaatcatagaagaaaatcatacaaaaccggaagatgttgttcaaatgcttctgtcggctacacctgatttgcacgctgttttcccggcaaaagctgttcgcgagctttcaggatggcagtatgtaccggtaacatgtatgcaggaaatggacgtaacaggcggtctgaaaaagtgcataagagtcatgatgacggtccagacagatgtccctcaggatcagatcagacatgtatatttagaaaaagctgtcgtattgaggcccgatttatcattgacaaaaaatactgaattgtaatacgataagaacagcttagaaatacacaagagtgtgtataaagcaattagaatgagttgagttagagaatagggtagcagagaatgagtttagttgagctgagacattatgtttattctacccaaaagaagtctttcttttgggtttatttgttatatagtattttatcctctcatgccatcttctcattctccttgccataaggagtgagagcaatgaatttccaatcaaacatttccgcatttttagaggacagcttgtcccaccacacgataccgattatggagaccttcacagtcgatacactgacacccattcaaatgatagagaagcttgacagggagattacgtatcttcttgaaagcaaggacgatacatccacttggtccagatattcgtttatcggcctgaatccatttctcacaattaaagaagagcagggccgtttttcggccgctgatcaggacagcaaatctctttacacaggaaatgaactaaaagaagtgctgaactggatgaataccacatacaaaatcaaaacacctgagcttggcattccttttgtcggcggagctgtcgggtacttaagctatgatatgatcccgctgattgagccttctgttccttcgcatacaaaagaaacagacatggaaaagtgcatgctgtttgtttgccggacattaattgcgtatgatcatgaaaccaaaaacgtccactttatccaatatgcaaggctcactggagaggaaacaaaaaacgaaaaaatggatgtattccatcaaaatcatctggagctccaaaatctcatcggaaaaatgatggaccaaaaaaacataaaagagctgtttctctctgctgattcatacaagacacccagctttgagacggtatcttctaattatgaaaaatcggcttttatggctgatgtagaaaaaatcaaaagctatataaaagcaggagatatcttccagggtgttttatcacaaaaatttgaggtgccgataaaagcagatgcttttgagttataccgagtgcttaggatcgtcaatccttcgccgtatatgtattatatgaaactgctagacagagaaatagtcggcagctctccggaacggttaatacacgttcaagacgggcacttagaaatccatccgattgccggtacgagaaaacgcggcgcagacaaagctgaagatgagagactgaaggttgagctgatgaaggatgaaaaagaaaaggcggagcattacatgctcgttgatcttgcccgaaacgatatcggcagagtagcagagtatggttctgtttctgtgccggagttcacaaaaattgtctccttttcacatgtcatgcacattatctcggtggttacaggccgattgaaaaaaggggttcatcctgtcgatgcactgatgtctgctttcccagcggggactttaacaggcgcacccaaaatccgtgccatgcagcttttgcaagagctcgagccaacaccgagagagacatacggaggatgtattgcctacattgggtttgacgggaatatcgactcttgtattacgattcgcacgatgagtgtaaagaacggcgttgcatcgatacaggcaggtgctggcattgttgctgattctgttccggaagccgaatacgaagaaagctgcaataaagccggtgcgttgctgaaaacgattcatattgcagaagacatgtttcatagcaaggaggataaagctgatgaacagatttctacaattgtgcgttgacggaaaaacctttactgccggtgaggctgaaacgctgatgaatatgatgatggcagcggaaatgactccttctgaaatggggggtatattgtcaattcttgctcatcggggggagacgccagaagagcttgcgggttttgtgaaggcaatgcgggcacacgctcttacagtcgatggacttcctgatattgttgatacatgcggaacagggggagacggtatttccacttttaatatctcaacggcctcggcaattgttgcctcggcagctggtgcgaaaattgctaagcatggcaatcgctctgtctcttctaaaagcggaagcgctgatgttttagaggagctagaggtttctattcaaaccactcccgaaaaggtcaaaagcagcattgaaacaaacaacatgggatttctttttgcgccgctttaccattcgtctatgaaacatgtagcaggtactagaaaagagctaggtttcagaacggtatttaatctgcttgggccgctcagcaatcctttacaggcgaagcgtcaggtgattggggtctattctgttgaaaaagctggactgatggcaagcgcactggagacgtttcagccgaagcacgtcatgtttgtatcaagccgtgacggtttagatgagctttcaattacagcaccgaccgacgtgattgaattaaaggacggagagcgccgggaatataccgtttcacccgaagatttcggtttcacaaatggcagacttgaagatttacaggtgcagtcaccgaaagagagcgcctatctcattcagaatatttttgaaaataaaagcagcagttccgctttatctattacggcttttaatgcgggagctgcgatttacacggcgggaattaccgcctcactgaaggaaggaacggagctggcgttagagacgattacaagcggaggcgctgccgcgcagcttgaacgactaaagcagaaagaggaagagatctatgcttgaaaaaatcatcaaacaaaagaaagaagaagtgaaaacactggttctgccggtagagcagcctttcgagaaacgttcatttaaggaggcgctggcaagcccgaatcggtttatcgggttgattgccgaagtgaagaaagcatcgccgtcaaaagggcttattaaagaggattttgtacctgtgcagattgcaaaagactatgaggctgcgaaggcagatgcgatttccgttttaacagacaccccgttttttcaaggggaaaacagctatttatcagacgtaaagcgtgctgtttcgattcctgtacttagaaaagattttattattgattctcttcaagtagaggaatcaagaagaatcggagcggatgccatattgttaatcggcgaggtgcttgatcccttacaccttcatgaattatatcttgaagcaggtgaaaaggggatggacgtgttagtggaggttcatgatgcatcaacgctagaacaaatattgaaagtgttcacacccgacattctcggcgtaaataatcgaaacctaaaaacgtttgaaacatctgtaaagcagacagaacaaatcgcatctctcgttccgaaagaatccttgcttgtcagcgaaagcggaatcggttctttagaacatttaacatttgtcaatgaacatggggcgcgagctgtacttatcggtgaatcattgatgagacaaacttctcagcgtaaagcaatccatgctttgtttagggagtgaggttgtgaagaaaccggcattaaaatattgtggtattcggtcactaaaggatttgcagcttgcggcggaatcacaggttgattacctaggatttatttttgctgaaagcaaacgaaaagtatctccggaagatgtgaaaaaatggctgaaccaagttcgtgtcgaaaaacaggttgcaggtgtttttgttaatgaatcaatagagacgatgtcacgtattgccaagagcttgaagctcgacgtcattcagcttcacggtgatgaaaaaccggcggatgctgctgctcttcgcaagctgacaggctgtgaaatatggaaggcgcttcaccatcaagataacacaactcaagaaatagcccgctttaaagataatgttgacggctttgtgattgattcatctgtaaaagggtctagaggcggaactggtgttgcattttcttgggaatgtgtgccggaatatcagcaggcggctattggtaaacgctgctttatcgctggcggcgtgaatccggatagcatcacacgcctattgaaatggcagccagaaggaattgaccttgccagcggaattgaaaaaaacggacaaaaagatcagaatctgatgaggcttttagaagaaaggatgaaccgatatgtatccatatccgaatgaaataggcagatacggtgattttggcggaaagtttgttccggaaacactcatgcagccgttagatgaaatacaaacagcatttaaacaaatcaaggatgatcccgcttttcgtgaagagtattataagctgttaaaggactattccggacgcccgactgcattaacatacgctgatcgagtcactgaatacttaggcggcgcgaaaatctatttgaaacgagaagatttaaaccatacaggttctcataaaatcaataatgcgctaggtcaagcgctgcttgctaaaaaaatgggcaaaacgaaaatcattgctgaaaccggtgccggccagcatggtgttgccgctgcaacagttgcagccaaattcggcttttcctgtactgtgtttatgggtgaagaggatgttgcccgccagtctctgaacgttttccgcatgaagcttcttggagcggaggtagtgcctgtaacaagcggaaacggaacattgaaggatgccacaaatgaggcgatccggtactgggttcagcattgtgaggatcacttttatatgattggatcagttgtcggcccgcatccttatccgcaagtggtccgtgaatttcaaaaaatgatcggagaggaagcgaaggatcagttgaaacgtattgaaggcactctgcctgataaagtagtggcatgtgtaggcggaggaagcaatgcgatgggtatgtttcaggcatttttaaatgaagatgttgaactgatcggcgctgaagcagcaggaaaaggaattgatacacctcttcatgccgccactatttcgaaaggaaccgtaggggttattcacggttcattgacttatctcattcaggatgagttcgggcaaattattgagccctactctatttcagccggtctcgactatcctggaatcggtccggagcatgcatatttgcataaaagcggccgtgtcacttatgacagtatcactgatgaagaagcggtggatgcattaaagcttttgtcagaaaaagaggggattttgccggcaatcgaatctgcccatgcgttagcgaaagcattcaaactcgccaaaggaatggatcgcggtcaactcattctcgtctgtttatcaggccggggagacaaggatgtcaacacattaatgaatgtattggaagaagaggtgaaagcccatgtttaaattggatcttcaaccatcagaaaaattgtttatcccgtttattacggcgggcgatccagttcctgaggtttcgattgaactggcgaagtcactccaaaaagcaggcgccacagcattggagcttggtgttgcatactctgacccgcttgcagacggtccggtgatccagcgggcttcaaagcgggcgcttgatcaaggaatgaatatcgtaaaggcaatcgaattaggcggagaaatgaaaaaaaacggagtgaatattccgattatcctctttacgtattataatcctgtgttacaattgaacaaagaatactttttcgctttactgcgggaaaatcatattgacggtctgcttgttccggatctgccattagaagaaagcaacagccttcaagaggaatgtaaaagccatgaggtgacgtatatttctttggttgcgccgacaagcgaaagccgtttgaaaaccattattgaacaagccgaggggttcgtctactgtgtatcttctctgggtgtgaccggtgtccgcaatgagttcaattcatccgtgtacccgttcattcgtactgtgaagaatctcagcactgttccggttgctgtagggttcggtatatcaaaccgtgaacaggtcataaagatgaatgaaattagtgacggtgtcgtagtgggaagtgcgctcgtcagaaaaatagaagaattaaaggaccggctcatcagcgctgaaacgagaaatcaggcgctgcaggagtttgaggattatgcaatggcgtttagcggcttgtacagtttaaaatgaggtgactgatttgcgtatcaaagaacatttaaaacagctgaagccttatcagcctggaaagccgattgaagcagtgaaatcagaatatggcttggataaagttgtgaagcttgcttcaaacgagaatccttacggctgttcagaggctgcaaaagaggcgcttcatcatgagattcaacagctagccctttacccggacgggtatagcgccgctttgcggacaaggctcagtaagcacctcaatgtcagcgaaacatcacttattttcggcaacggttctgatgaaatcatacagatcatctgccgggcatttttaaacgataaaacaaacacggttactgctgcccccacttttccgcaatataaacataatgcggttattgaaggtgctgaagtacgtgaaattgcacttcgtcccgacggctcacatgatttagacgccatgttagaagccatcgacgaacagacacaagtcgtttggatatgcagcccgaataatccgactggcacttatacatctgaaggagaattactcgcatttctggagcgcgttccttctcgtgtccttgtcgttcttgacgaagcatattatgaatatgtaacagcagaggattacccggaaaccgtgccgctcttaagcaagtattccaatttgatgattttgcgcacattttcaaaggcatacggtctggcagcgctcagagtcggatacggaattgctgacgagaacctgattcgccagattgagccggcgagagagccgtttaataccagccgtctgggccaggctgcggcgattgcagcacttgatgatcaagcgtttattgcttcttgtgtcgagcaaaataatgcaggccttcagcagtattatgattttgcgaaaactcatggtttaaagtgctacccttcacagacaaattttgtgttaattgactttaaacgtcctgctgatgaactgtttcaggctctgctggaaaaaggctatatcgtccggtcaggaaacgcattaggtttcccgacatcactccggattacgatcggaacaaaagagcaaaatgaagaaatacttgccattttagctgaaattttataagaggtgatcaaatatcacctctttagtctataaaccaggtgatgacgtatgaatcaaatgaaagatacaatattgctcgccggtctcggattgataggcggttcgattgccctagccatcaaaaaaaatcatcccggcaaacggattatcggaatcgacatctctgatgaacaggcggtagcggcattaaaattaggcgtgatagacgatcgtgctgattcgtttattagcggtgtgaaagaggcagctacagtaatcattgcgacacctgttgaacaaacactggttatgcttgaagagctggctcattcaggaattgaacatgagcttttgattacggatgtaggaagcacaaagcaaaaagtggttgattacgctgatcaagtgctgcctagccgctatcaatttgtcggagggcatccgatggcgggttcacataaatcaggagtggccgctgcgaaggagttcctgtttgaaaatgcattttatattttaacgccaggccagaaaacggacaaacaagctgtggaacagttaaaaaacctgctgaaggggacgaatgcccattttgtggaaatgtcgccagaggagcatgatggcgttacaagcgtaatcagtcattttccgcatattgtagcagctagccttgttcaccaaacccatcattcggaaaacctgtatccgcttgttaagcgttttgctgccggcgggttcagagatattacaaggattgcatcaagcagcccggcaatgtggcgggatattttattacataataaagataaaatcttagaccgttttgatgagtggattcgtgaaattgacaagatccgtacatatgtagaacaagaagatgcggaaaatctatttcgttattttaaaacagccaaggattatcgcgacgggctgccgcttcggcagaagggagcgatacctgcattttatgatttatatgtggatgtacccgatcatccgggtgtaatatccgagataacagcgatcttagctgcggagcgcatcagtatcacgaatatccgcattatcgaaacacgagaggatattaacgggattttaaggatcagttttcagtctgatgacgaccgcaaaagggcagaacaatgcattgaagcccgggcggaatatgaaactttttatgctgattgaggtggaaaaaatgaaacgagataaggtgcagaccttacatggagaaatacatattcccggtgataaatccatttctcaccgctctgttatgtttggcgcgctagcggcaggcacaacaacagttaaaaactttctgccgggagcagattgtctgagcacgatcgattgctttagaaaaatgggtgttcacattgagcaaagcagcagcgatgtcgtgattcacggaaaaggtatcgatgccctgaaagagccagaaagccttttagatgtcggaaattcaggtacaaccattcgcctgatgctcggaatattggcgggccgacctttttacagcgcggtagccggagatgagagcattgcgaagcgcccaatgaagcgtgtgactgagcctttgaaaaaaatgggggctaaaatcgacggcagagccggcggagaatttacaccgctgtcggtgagcggcgcttcattaaaaggcattgaatatgtatcacctgttgcaagcgcgcaaattaaatctgctgttttgctggccggattacaggctgagggcacaacaactgtcacagagccccataaatctcgggaccacactgagcggatgctttctgcttttggcgttaagctttctgaagatcaaacgagtgtttccattgctggtggccagaaactgacagctgctgatatttttgttcctggagacatttcttcagccgcgtttttccttgctgctggcgcgatggttccaaacagcagaattgtattgaaaaacgtaggtttaaatccgactaggacaggtattattgatgtccttcaaaacatgggggcaaaacttgaaatcaaaccatctgctgatagcggtgcagagccttatggagatttgattatagaaacgtcatctctaaaggcagttgaaatcggaggagatatcattccgcgtttaattgatgagatccctatcatcgcgcttcttgcgactcaggcggaaggaaccaccgttattaaggacgcggcagagctaaaagtgaaagaaacaaaccgtattgatactgttgtttctgagcttcgcaagctgggtgctgaaattgaaccgacagcagatggaatgaaggtttatggcaaacaaacgttgaaaggcggcgctgcagtgtccagccacggagatcatcgaatcggaatgatgcttggtattgcttcctgtataacggaggagccgattgaaatcgagcacacggatgccattcacgtttcttatccaaccttcttcgagcatttaaataagctttcgaaaaaatcctgaagttttacttcaggattttttatgcagatcataatttgaggcaaaaaaacatagcttgtcttatagaggggatagaaaaacgaaaaggggggatgtgctttacttacaagccggcaggtcaaagagctgctttactgtacagagggcgatcttccttttttcattttctatctcaagatcttttggtaaactaataagactcaataattcccttccgtacagaagcatcttatttgccgggggcattcgtctgaattatgataagattaacccgaacaaataaagcttttttgtatggttgatgttgtataggaaaagaaaggaccggtccgatttgaatacattgattcaagaagccataaaattagttgaagcaggtgaaacagaaaaaggcctcaacacgctctcgaaggctgaaaaacagctgcatgatgaagataaagccattgcagcccagctttattacgagtggggcgatgtagaaaaagcaatttcactgattagtgatctacatgatttatatccaaatgaaacagaactgacgaatttctacgctgaacttttaatagatattgacgaagaagaaaaagccctcgctgtgctggagactattccggaaacagatccatcatatccagaaagtttgctgcttatggcggatctttatcagatgcaggggttattcgaagtcagtgaacaaaagcttttacaagcaaagtccattctggacaatgaacctgttattgattttgcactgggagaactttactttgctcagggagcctatgcaaaagcggttcaatattttaaaacaacggctgaggagcagggggagatcggaggcgttaatgtccatcaaagactggcagaatcgttaagtgcctcaggtgaatttgaggatgccattccatggtacgagaaagctgtcgatgagaatcctgatcctaatacgattttcggctatggttttacagccttacaggcggggcttgtgaaaacagctattaagcagctgtctgatttaaaggagcttgatccatcttatacttcactttatatgccgctctcgaaaagctatgaagctgaaggaatgtatgaagaggcattaaaaacggcaaaagaggggatcagatatgatgaatataacaaagaacttttcctttatgccgccaaaatggccttaaaaatcgggaagtcagaagaggggaaaaagctgcttcaggaggcgcttgcgcttgatccgggctttgttgaggcgcttcatacacttcttgccgtgtatcacaaagaagaggattatgatcagatcattgatcttattcaagaggttcgaagctacggtgaagaagatccgaaatacaattggtatcttgcaagcgcatatactgaattagagcaatacgaggaagcaaaacaatcctttgaggctgcctatcttcattaccgggaggatagagatttcttatatgaatacgcaagcttcctattagaagaaggtcttcaaaaagaagcgctgccgcttttgaaaaaggttcttgaaatggacggagccaatgaagaactggaagaaacgattttgcgaatcgaggatgaattttctagataagcaggaatattaaccattcatgtggaacatataagtatatagattatacgaacgatagaggagggaattacatgcagacccctgtttctgtcaatgagaaaaaagattttatccgttggtttttaaaccattatcagttaaagcgccgagagtgcgtttggatcttgaactacttaatgagccatgattctctcatggagaaggttcattttgtggagcaggctgaattttgcccgagaggcattataatgtcaacacattgtgttgaagaagttccgttccggttctataaagagaatgtcatgactaccgacgcggaaaaatcttttcatgatattagattaaataaacagcaagatttgtttatccagcttaatttccgttcggcttacagctcacctgaatatgcggcggtgctggagtccaacccgcatattccgaaaaacctttttgagaataaaaaagatcagggattggcggaacagattttagagcacgctatttccacattccaaagagaaaaattattaaaagacattgacgaggcgttagatcgtcatgataaagaggcatttgaacaattatcgcgccaattaaatcagctcacataatatgaccagccttgcagtgaattgcaaggcttgttgccgtaaagggggagaacgatgaggtggagaatcactgatgccaaggactatttacaagctaaggattacattgataccgctgtcataccattaattaacataagagttaataaccattttaaaatggcggcggagaaaggcgagtttacgcagcttctctcagaagaacttgaaaggcagttaaagggacgggtatatttacttcctccttatacatatgttgatagaaatgaaataaccgttcaagggcttaaggatttgcgggaagagctgataacggaatttccgcatgttgtcctgctcacatctgacgaaagttggagagctgaggatgcgttaggcaaaatgattgttacaccgtctgttccattagagcatttaaatgactctttaaaaagaaaaatattggatgaacgcactgctgaaattttgaacgttttgttacagttatggagcacttcataaaaacacttacatttccttataaacaatattttggctatattgaccttgctgagagattcatatattatgagggtgtctagagttattgcaatattttctattttagtcagtttgcaggggtgacctagaggggggagaagagatgggcggaaaacatgatatatccagacgtcaatttttgaattacacgctcacaggtgtaggaggttttatggcggctagtatgctcatgcctatggttcgcttcgcactcgacccggtattaaaatcgacagggaagcaggatatggttcaggttgtcagcgttgatgagttgacaaaagagccgcagcgctttgattttaaaattaatcaagtcgatgcctggtatgagtcagaagagtctagatcagcctgggtcttcaaaaacggggatgaaattgtagcactttcgccaatttgtaagcatttagggtgtacggtgaactggaatagtgatcctaaaaacccgaataaattcttttgtccatgccattacggactctatgaaaaggacggcaccaatgtccctggcacgccgccgcttgcgcctcttgatcattatgagcaagaagtaaaagacggcttcctgtatcttggaaaagcaaagcctaagggggaagggtgacatgctgaacaaaatttatgactgggtagacgagcggcttgatattacaccgatgtggagggatattgccgatcacgaagtaccggaacatgtgaatcccgcccatcatttctctgcgtttgtgtattgctttgggggactgacgttttttgtaaccgttatccaagtattatctggaatgtttttaacgatgtattatgtgcctgatatcaaaaatgcctgggaatcggtatattatttgcaaaatgaagtggcattcggccagattgtcagggggatgcaccactggggtgcgagcctggtcattgtgatgatgtttttacatacgctgagggtctttttccaaggcgcgtataaaaaaccgcgcgagctgaactggattgtcggtgtgctgatcttttttgttatgctcggtcttggctttacaggctacttgcttccttgggatatgaaggctctgtttgcaacaaaagtcgggctgcagatcgccgaagctacgcctttgatcggaacgcaagttaaaacgctccttgcagggcatccggatattgtaggcgcccaaacgctaactaggttttttgcgatccatgtattttttcttcctgccgcattgttcgggctgatggctgcacattttattatgatccggaagcaggggatttcaggaccgctttaaactcttgatctgcgaataaaagggaggggatgacatgcaccggggcaaagggatgaaatttgtaggcgactcaaggataccggctgaaaaaaagccgaatataccgaaggattattcggagtatccgggtaaaacagaggctttctggccaaatttcttgttaaaggaatggatggttggagctgtctttctcatcggttttctcgttttgacgattgtgcatcagccgcctttggagcggatggcggacccgactgatactggttatattccgctgccggattggtattttcttttcttataccagctgttgaagtatgaatacgccgccggaagctttacagtggtcggcgccatgattatgccaggtctcgcttttggggccctgcttttggctccattcctagacagagggacagaaagaaggccgtggaagcgtccggtcgctgtcggtatgatgcttctggccatttccgctgctgtatttttgacgtggcagtcagttgctactcatgactgggccaaggcagaagaacaggggaaaattacaaaagaagccgacattgacaccaatgcagaaggatataaggtttttaaggaacagggctgtatttcttgccatggggataaccttcagggaggagcggccgggccttcattggttgacagcgggctgaaaccggatgaaatcaaaaaaatcgctgtagaagggaaaggcaaaatgccggcgggtgtgttcaaaggaaatgataagcagctcgaagaacttgcaaaatttatttctgaaacaaccgcaaaataacgtattgtgaattgtcaaatggaaggatatacttttattatcaaaagctgacccggcgtcagcttttttatttggacatattatttttacagactgagagttgattcgatgtgaaatggtttcaatatgtattagggcagcggccgatgcttattcttgtcttagccattaattttctgggaacggtttacggctactattggtacttgccgcagcttttggagacaccggcacgtttcctgatttttgttccggacagtccgacagcaacgtttttctttctgtttgtgctgcttgcctttctcatgaaacggaatgctccgttctttgaggcgcttgcgctagttaccctcgtaaagtatggcctatgggcggtggctatgaattttcttgtgcttgcagtaactggtgacttgccgtgggagggctacatgctaattgcttcgcattttgcaatggcagttcaaggcgtattatacagtccgtattttcgtttttcattttggcatcttgcaattgctgcagtctggacactgcataacgatgtcattgactacttgtttgatatgatgccgcaatactctatgctttctgattatatgactgaaataggatacggaacattttggctaagcatcttttcaatcgcgcttgcttactttcttgtggtctcaaaaaaacaaacgaagcttgagctgatgtaaagacaatgttggtctatccttgtccctttcttcatattctgtaaggagagagagtgggagggacctgcatgaaacgaaagctgacgatctgtttgttgattgcacttattttttataatggaaatgccaaggctgcagagcggggaagcctcgaggaattgaatgatttatccgatacagtctttcaaatgacccgacaggcgaaatatgaagaggcgcttcaagtcttggagtattttgaaaaaacattaaaatccgctgagaaaaaacagcaagaccccatgctaacgggagcccaaattcgtcaaatcacattgggctataatgatatggttcggagtttaaagcaagctgatacatcagacacacaaaaactcagagcagccgcgcagttcagaatgctgatggatgcggttgacaatcggtctgacccgctttggggctcactggaaaaaccgattatggaagcttttactgagctgaagcgagatgtccagaagaatggaagcacaagctttcatgaaaaatggaatgaatttatcagtttatatgacttgatttaccccagtcttacaatcgatgtatcagaggatcagcttgaaacagtcggaaaacatatagatgttattgagcaagaggaatttcagcaaatgacagagagcacgaagcttgaacggctttcccttcttcagcatgacctgaaaaatgtgtttgacagggtggaggaggatgatgccgatccgtctttactctgggtgatgattacaaccggcagtatcatcattactgctcttacctatgtcggttacagaaagtacaaggcggaaaaaaacaagctgaaaaaaagggactaccctaaataaggatgaggggcggcggtcagccgccttttttctattacatgtcagcgcggaagcggatttttattttcatcaagcgtaaatccttctccgagcacatcgtgaacatcgcttaccgctacaaaggcatggggatcaatggagttaatcacgcttttcagcatcaccaattcgtttttcggtaccacacaataaagtacatctatatcctcttttgtgtaggaaccttgtcctttcaaaatggtgacgccgcgttccatttcttcaagaatctttttctgaatcaggtcatttttcgaggagatgatcgtagcgcctttagcagcgtatccgccttcctgaataaaatcgattaatcttgccgctacaaatacagctaccagcgtatacatcgcttctttataggagagataagtaagcaaagacaaaatgatgacgcaggcatcgaaagcaaacatcgttctgcccatcggaatcccaaaatacttattcactaaacgtgcgatgatatcaacaccgcctgtcgtaccgccgaacttgaaaataatacccagtccggctccgatgaatacgccggcaaataaagcggcgagcgctaagtcgtgctgaaggggcatatggatttcatatcgctgaaagatgctgaggaacaaagacaaggctacagtgccgacaagggtataaacaaacattgtcctgccgagcaaacgccagccaataaaaaaaatcggaatgttcaacaccaggttcgagatagaggggctgatgtggaaaagggcataaagcaaaagtgtaatacctgtaaaaccgccctcagccagattgttctgcatattgaaatgaaccaagccaaatgaaaaaattgccgctccgattaaaataaaaaatatgttttttaatctaatttctccaagcatcacacaaaaccccttttccttccattagatagcgtttatattatagtggatgaaaaagaaaacagcaaacgtgcttaaacatttgtcaaacgtatctgaattagctaacatgtaagaggatgataggaggtttcgttcagtgagtgataaaacaatgaaagacatacaggctgaagtagaccgttacatcggccaatttaaagaaggatatttcagcccgctggccatgatggcgaggctgactgaagaactgggcgagcttgccagagaagtgaatcaccgttatggagaaaaaccaaaaaaagcgactgaagatgataaaagcatggaagaggaaatgggcgatgtgctatttgtattggtttgtttagccaactcccttgatatctctttagaggaagcccacgaccgagtcatgcataaatttaatacaagagataaagatcgctggaccagaaaagaagaaggaaagtagaggagatcgagatgtcaaacgaaacaattaaagtagtcattgcgggaccgcgtggaagaatggggcaggaagctgttaaattggcagaacgaacacctcattttgaccttgtcggggccatagaccatacatacgatcagcaaaaattatctgatgtgatgcctgttgagtcagatgctttcatttatacagatatccatgcctgttttacagaaacacaaccggatgtcttgattgatttaacaacgcccgaaatcggaaaagtacatacaaaaattgcattagagcacggagtccgtccagttgtcggaacaaccggtttctcagaagctgatttaaaagagctcacatctttaacagaagaaaaagggatcggagccatcatcgcgccaaattttgcgctcggtgcgatactgatgatgaaattttcaaaaatggctgccaactattttgaggatgttgagattattgagcttcatcatgaccagaagcttgacgcaccaagcgggactgcgcttaaaacagcggaaatgatttcagaagtccgtaaagaaaagcagcaaggacatccggatgaaaaagaaattctcccaggagcaagaggagcggagcaaaacggcattcgcttgcacagcgtccgtcttccgggactgatcgcgcatcaggaggtcatgttcggcatggatggccaaacgcttcagatacgccatgattcttataaccgtgcttctttcatgtcaggcgttaaactgtcagtcgaacaagtcatgaagattgatcagcttgtgtatggtttagaaaatatcattgattagacggggggataaacaatgaaaattgctttgatcgcgcatgacaagaaaaaacaggatatggttcaatttacgactgcctatcgggatattttaaagaatcatgatctatatgcaaccggaaccacagggttgaaaattcatgaggcgacaggtcttcaaattgaacgttttcaatccggccctttagggggagaccagcaaatcggtgcactgatcgctgccaatgcactcgatcttgtcatttttttgcgcgacccgctgaccgcgcagccgcatgaaccggatgtctcggcattaatccggttatgtgatgtgtattccattccgctcgccacaaatatgggtactgcggaaattctcgtccgcacacttgatgaaggtgttttcgaattccgtgaccttcttcggggagaagagccgaatgtataatgctgacgttcttgcttttggcgcccacagtgatgatgtcgagatcggaatgggcggcacaatagcgaagtttgtcaaacaggaaaaaaaagtaatgatatgcgatttgacagaagcggaactctcttctaacggtacggtcagtttgcgtaaagaagaagcagctgaagcagcccgcatattaggcgcagataaaagaattcagctaacgcttccagaccgcggcctaataatgagtgatcaggcaattcggtcaattgtcactgtcatcagaacctgtcggccaaaagcggtttttatgccgtataaaaaggatcgccatccggatcacggcaatgcggctgcactggtggaagaagcgatcttttccgccggaatccataaatataaagacgaaaaaagccttccggcgcataaagtcagcaaggtttactattatatgataaatggttttcatcagccggattttgttattgatatctcggatacaatagaggcaaagaaacaaagcctcaacgcctacaaaagccagtttatcccgtcaaaggattccgtttctactcctctgacgaatgggtatattgaaatcgttgaagcgagagaaaagctttacggtaaagaagcgggcgtggagtatgccgaaggtttcttttccaaacggatgctgatgcttgatcatgatgtgattgggggcgaacaatgagaaaactaaaaataggaatcacatgctatccgagcgttggaggctcaggtatcattgcgacagaactggggaagcagcttgctgaaaagggacatgaaatccatttcatcacatcaagcattccgtttagactgaatacatatcattccaatattcattttcatgaagttgaggttaatcaatatgctgtttttaagtatcctccgtatgatttgacattggcaagcaaaatcgcagaggtggcggaacgggagaatttagacattatccatgctcactatgctctcccgcatgccgtttgcgcctatcttgcaaaacaaatgctgaaacgcaatatcggcattgttacaactttgcatggcacggatatcacggtgttaggttacgatccgtctctaaaagatctgatccgttttgctattgagtcatcagacagggtgacggccgtctcctcagcgcttgcggctgaaacatacgatttaattaaaccggagaaaaaaattgaaacgatttataactttatagacgagcgcgtgtatctgaagaaaaacacagcggtaattaaagagaaacatggaattttaccagatgaaaaagtcgtcatccatgtgtccaacttcagaaaagttaaacgcgtgcaggatgtcatccgtgtgttccgcaatatcgctggcaaaacgaaagcgaagctgcttttagtcggagacggtccggagaaatcgacagcctgcgagcttatcagaaaatatggcttggaagaccaagtcttaatgcttggaaatcaagaccgtgttgaagagctttattctattagcgatttgaagctgctgctatctgaaaaagaaagctttggacttgtcctgcttgaagcgatggcttgcggagtgccttgtattggaacaaatattggcggtatccctgaggttattaaaaacaatgtgagcggatttttggtggacgtcggtgatgttggggccgcaacagcccgcgcgatgagcattttagaagatgaacagctaagcaatcgttttacaaaggcggcaatagagatggttgaaaatgaattttcttccaaaaaaattgtcagccagtatgaacagatttatgccgatttagcagaaccggagtgatcacatggaaaaagtttttatcaaagcacttcccgtgctccgcatcttaatcgaagcaggccatcaggcttattttgtcgggggcgcagttcgtgacagctatatgaaacgaacgatcggagatgtcgatatcgcgacagatgcggcacctgatcaagtagaacggctgtttcagcggactgttgatgtaggcaaagagcacgggaccattattgtgctctgggaggatgaaacctatgaagtcacgacattccggactgaatctgattatgttgatttcagaagaccgtcagaagtgcaatttatctcatcattagaagaggatctaaaacgaagagatttaacgatcaatgcgatggccatgacagcggacgggaaggtgcttgattattttggcggcaagaaagatattgatcagaaagtgattcgaaccgttggaaagcctgaggatagatttcaagaggatgcgcttcgtatgctgagagccgtacgctttatgagccagcttggctttacgctttcaccggaaacagaagaagccattgcgaaagaaaaatcactcctctcccatgtttcagtcgaacgaaaaactatagagttcgagaaattgctgcagggaagagcttctcgccaggcgcttcaaacactcattcaaacgagattgtatgaagagcttcctggtttttatcataaacgagaaaacctgatttcaacgagtgagtttccattcttctctttaacatcccgtgaggagctttgggctgctcttttaattaaccttggcatagttttgaaagacgcgccgcttttcctgaaaggttggaagctcccgggaaaagtgatcaaggaagccattcacattgccgatacgtttggccagagccttgacgtaatgacaatgtacagagctggggaaaaagcactgctctcagcggccaaaatatcgcagcttcggcaaaacgaaaaactggatgaaaagaaactgaaggacattcagtacgcttatcaaaacctgccgatcaaaagccttaaggatcttgatatcacgggtaaggacttgcttgcgcttcgaaaccggccggccggaaaatgggtgtcggaagaattacagcggatcgagcaggctgttgtgacagggaagctctccaatcaaaagaaacacatagaggagtggctgaagacatgcggtcaacattaagaaaagaccttattgaattattttctcaggccggcaatgaatttatttccggccaaaaaatcagtgatgctctcggctgttcaagaactgctgtgtggaagcatattgaagagcttcggaaagagggttatgaagtagaagccgttagaagaaaaggatatcggctcatcaaaaaacccggaaaactcagtgaaagcgaaattcgttttggattaaaaacggaagtgatgggccagcatcttatttaccatgacgttctttcaagcacgcaaaaaactgctcatgagctcgcgaataataacgcaccggaaggcacccttgtggtggctgacaaacaaacagccggaaggggccgaatgtctagggtatggcattctcaagaaggaaacggtgtttggatgagcctgattttgcggcctgacattccgctccaaaaaacaccgcagctgactctgcttgctgcagtagctgttgtgcagggaatagaagaggcagcaggcatccaaacggatattaaatggccaaatgatattttgattaacggaaaaaaaacagtcggtatcctaacggaaatgcaggctgaagaagaccgcgtacgttcagtgatcattgggatcggcattaacgttaaccagcagcctaatgattttccagatgaattgaaggacatcgcgacaagcctcagccaagctgctggggaaaaaattgatcgggccggcgtcatccagcatattttactatgctttgagaaacggtaccgggattatatgacgcacggatttacgccgattaagcttttatgggaaagctatgcgctcggtattggcactaatatgagagccagaacgttaaacggaaccttttacggtaaggcgttaggtatagatgatgaaggcgttctgcttttagaaacgaacgaaggcattaaaaaaatctattctgccgatatcgaattgggctaatgtgttggtacaagcccgttgattttggtatacttccattgggcagtatcgcctgcgaactgcacctattattaaaatagatagacattgcagcagtctgccttgatccaaaaaaggactgggacagagggatgaaactcgccgaactttagaaagtgaagaatccttctcgttgtaacggaaggttttttggcttgtagaagaaaacggcagatcatctcctctaaacataaggaggagaaaacatgaaaacaaaactggattttctaaaaatgaaggagtctgaagaaccgattgtaatgctgaccgcttatgattatccggcagctaaacttgctgaacaagcgggagttgacatgattttagtcggtgattcactcgggatggtcgtcctcggccttgattcaactgtcggtgtgacagttgcggacatgatccatcatacaaaagccgttaaaaggggggcgccgaatacctttattgtgacagatatgccgtttatgtcttatcacctgtctaaggaagatacgctgaaaaatgcagcggctatcgttcaggaaagcggagctgacgcactgaagcttgagggtggagaaggcgtgtttgaatccattcgcgcattaacgcttggaggcattccagtagtcagtcacttaggtttgacaccgcagtcagtcggcgtactgggcggctataaagtacagggcaaagacgaacaaagcgccaaaaaattaatagaagacagtataaaatgcgaagaagcaggagctatgatgcttgtgctggaatgtgtgccggcagaactcacagccaaaattgccgagacgctaagcataccggtcattggaatcggggctggtgtgaaagcagacggacaagttctcgtttatcatgatattatcggccacggtgttgagagaacacctaaatttgtaaagcaatatacgcgcattgatgaaaccatcgaaacagcaatcagcggatatgttcaggatgtaagacatcgtgctttccctgaacaaaagcattcctttcaaatgaaccagacagtgctggacggcttgtacgggggaaaataagatgagacagattactgatatttcacagctgaaagaagccataaaacaataccattcagagggcaagtcaatcggatttgttccgacgatggggtttctgcatgaggggcatctaaccttagcagacaaagcaagacaagaaaacgacgccgttattatgagtatttttgtgaatcctgcacaattcggccctaatgaagattttgaagcatatccgcgcgatattgagcgggatgcagctcttgcagaaaacgccggagtcgatattttatttacgccagatgctcatgatatgtatcccggtgaaaagaatgtcacgattcatgtagaaagacgcacagacgtgttatgcgggcgctcaagagaaggacattttgacggggtcgcgatcgtactgacgaagcttttcaatctagtcaagccgactcgtgcctatttcggtttaaaagatgcgcagcaggtagctgttgttgatgggttaatcagtgacttcttcatggatattgaattggttcctgtcgatacggtcagagaggaagacggcttagccaaaagctctcgcaatgtatacttaacagctgaggaaagaaaagaagcgcctaagctgtatcgggcccttcaaacaagtgcggaacttgtccaagccggtgaaagagatcctgaagcggtgataaaagctgcaaaagatatcattgaaacgactagcggaaccatagactatgtagagctttattcctatccggaactcgagcctgtgaatgaaattgctggaaagatgattctcgctgttgcagttgctttttcaaaagcgcgtttaatagataatatcattattgatattcgagaaatggagagaatataatatgtatcgaacaatgatgagcggcaaacttcacagggcaactgttacggaagcaaacctgaactatgtgggaagcattacaattgatgaagatctcattgatgctgtgggaatgcttcctaatgaaaaagtacaaattgtgaataataataatggagcacgtcttgaaacgtatattattcctggtaaacggggaagcggcgtcatatgcttaaacggtgcagccgcacgccttgtgcaggaaggagataaggtcattattatttcctacaaaatgatgtctgatcaagaagcggcaagccatgagccgaaagtggctgttctgaatgatcaaaacaaaattgaacaaatgctggggaacgaaccagcccgtacaattttgtagaagaaaagccccctttatcgggggttttcttttaagattttgagagtaaaacggttttgccgctccatttccgtacaaaacgtgttacacttttgtcgtatgcaagaattgaggtgtccattttaatgaataagcaacggttcgttgttatagatgtagagacaacagggaattcgccgaagaaaggcgataaaatcatacaaatcgcagcggttgtaatcgaaaatggacaaattactgagcggttttcaaaatacattaatccaaataaatcaatccctgcttttattgagcagcttactggaatctctaatcaaatggtcgagaatgaacagccatttgaagcagttgctgaagaagtattccaattgcttgacggcgcttattttgtcgcccacaatatccattttgaccttggatttgtcaagtatgagctgcataaggcgggctttcagctcccagattgtgaagtgcttgatactgtcgagctctcacgtattgtttttccgggatttgaagggtataagctgacggaattaagcgaggagcttcagctgcggcatgatcagccgcaccgggctgacagcgatgctgaagtgacagggcttatttttttggaaatccttgaaaagctgcggcagcttccttatccgactttaaagcagttaagaaggctttcgcagcatttcatcagtgatctgacgcatttgttggatatgttcattaatgaaaacagacataccgagataccggactatacgcgcttttcttcgttttctgtcagagaacctgaagctatcgatgctcgtataaatgaggacgagaacttctcatttgagatcgaaagctgggaagcgggaaatgaaaaagcgctgtcagagttaatgcctgggtatgaaaaaagagacggccaaatgatgatgatgagagaggtggctgatgcgtttgccaatcgtgagcatgcgctgattgaagctcctccaggcatcggaaaaacgattggctatctgattccggctgcgctttttgccaagaaatcaaaaaagccggtcataatcagcacgtattcgacgcttttacagcagcagattctcacaaaggatttgccgattgtccaagatctgtttccatttccggtaacagcggcgattttaaaagggcaatcgcattatttatgcctgtataaatttgagcaggtgcttcatgaagaagatgataattatgatgccgtactgacaaaggcacagcttctcgtttggctgacagagacaaatacaggagatgtagcggaactgaatttgccttcaggcggaaaattgctgtgggacagattggcttatgacgatgactcctataaaagaagtcgcagtgagcatgtgatcggtttttacgagcgggccaaacagattgctatgcgttccgatttggtgatcaccaatcattctcttttgctgaccgatgaaggcagccagaaaaaaaggcttcccgaaagcggcacatttattattgatgaagcacaccattttgaacgtgcggcaagcgaacatttagggaaaagagccacgtacatagaattgcatacgaaattgagcagaatcggcactctgaaggagcagggacttctaaaaaagatgagacagctattccagcgaaacagcctgccggttgattcatttttcgaattggaagagtggcttcagcacgttcaagcagaaagtgatgctttcttcagctctgtacattcttttgtcaaacgaagaaaacctaaagaagacttaaaccgtctagtgtttaaggtgaacaaagaaagccaggataaaagctggtcgatcttaacagatggtgcggagaggctttgttccatgctgacacatttgcagcagctttttgaggcgcagtcatcccttatggaaaaacatttgaagggtatgaagagcaaaaccgtctttttagccgatgaataccaaagaagcatgaaaggcttgcagcattactgtcagacgttgcagaagctcttctttgggtctgatgacaatgaagcggtttggtttgaaatagatgcaaagggtgcgaaaaatgcagtggccatttacgcacagcctcttgaacctggtgaacttctggctgatcagtttttcgcgcgcaaaaatagtgtggtgctgacatctgcaacccttacagtcgaaggttcttttcaatttatgattgaacgactgggactgagtgactttttcccgcggacaatgagaattgagtcactcttttcttacgatgagcgtatgcaggtgatgattccaaaagaaatgaaatcaattcaggatacaggacaacctgaatttatacaggatacagcccgttatatcgaactgatggcaaaggaaaaacagcctaaaatccttgtgctgtttacatcccatgatatgctgaaaaaggttcaccaggagcttaagcataacatgagtgcttccggcattcagctcttggcacaagggattacaggcggaagtcccggcaagctgatgaagacttttaaaacatccaatcaggcgatcctgctcggaacaaatcatttttgggaaggcgttgatttccctggtgatgagctgacgacagtaatgatcgtgaggctcccattccggtcccctgatcacccgcttcatgctgcaaaatgtgagcttgcccgcaaaaaaggaaagaatccgtttcaaacagtgtcattaccggaagctgtgctgacctttaggcaaggaattggacgcttgctgcgttctgcgggagacaagggaacgattattatattggacagacggattaaaaccgctggttacggccggctgtttcttgatgccttgccgacaacctcagtatccgaaatgactgacagcgagcttgaagcttatgttgcaggggaaaaagaataaaagccgcataaagcggcttttgcggtgtgggagtaggatggtgttttatttgaaagcggatttcccgctctgtgatactagtatggcgtgtcctgaaatggagtatgactaacaatatttgttcaaactggaggatgaaaaaatggaaagtaaaatcgaaattctttcaacaattaatgtagagcattctgatgatctgtataaaattgtggacacattgaatcgtacactgaaaagagaaaatctgatgttcggccttgcgctggatgaagaaaacaaaaaccaagccgtttttaccatttatcgtacgtaggtgagaagatgagaaaaaaagcattaatatttaccgtcatttttggtattatttttttagcagtacttcttgtctcggcaagcatttataaatcagccatggcacaaaaggaagaggggcacgaagcagcagctgctgaagctaaaaaagaaaccgatctcgcccatgttgatcaagtcgaaacatttgtcggaaaagagaaatattatgttgtaaagggaacggataaaaaaggcactgcattatatgtctgggttcctgctgataaaaaagcaaaaattctctcaaaagaagcgaaagagggaatctctgaagacaaagcggcgaaaatcataaaggatgaagggctggtttcaaagcaaaaagaggttcatctggcaagagaaggaaacgtcctgctttgggaagtgacgtacttagacaaagaagggcaatacagtttaagttatgtggactttacaactggaaagattctcaaaaatatcacgccttaagacgaattagggggagttcaagttgaaactggcaaaaagagtatccgcattaacaccatcaaccacactggcaatcacagcgaaagcgaaagaactgaaagccgcaggccatgatgtcatcggcttaggagcaggcgaacctgacttcaatacaccgcagcatattattgatgccgctgtgcgttcgatgaacgagggccatacgaaatacacgccttccggtggtttggctgaactgaaaaacagcattgcagagaaatttaaacgcgaccagaatattgaatacaaaccgtctcaaattattgtctgcactggtgccaaacatgctctgtatacccttttccaagtgattttggatgaagaagatgaagttattattccaacgccttactgggtaagctatccggagcaggtgaaactcgctggcggaaagcctgtttatgtagaagggcttgaggaaaatcacttcaaaatttcgcctgagcagctgaaaaatgcaattacggaaaaaacaaaagcaatcgttattaactctccaagcaacccgactggtgtcatgtatacggaagaagaactatctgcgctcggtgaagtgtgccttgaacatgatatcttgattgtgtcagatgaaatttatgaaaaacttacatacggcggaaagaaacatgtttccattgcacagctgtcagacagactgaaagagcaaacggtcattataaacggcgtatcgaagtcccacagcatgacaggctggagaatcggttatgcggcaggctctgaagacattattaaagcgatgacgaaccttgcaagccacagcacgtcaaacccgacatcaatcgcacaatacggagcgattgctgcttataacgggccttctgagccattggaagaaatgagagaagcatttgaacatagattaaatacgatctatgcaaagctcatagaaatcccagggttcagctgtgtgaagccggaaggtgctttttacttgttcccaaatgcaaaagaggcagctcaatcttgcggtttcaaagatgtagatgaatttgttaaagcgcttctcgaggaggaaaaagttgcgattgttccaggatccggatttggctctcctgagaatgtccgtctttcttatgcaacatcgttagatcttcttgaaaaagccattgaaagaatcaagcgttttgtagaaaaacatagctaacagatcaaaaagcggctgacagaaaagccgctttttatctgcattgacccggttagttaagagcgggtataataaagtgatgataaaagagttcgcggggcaatgagcttccgaatgtctttcttgttttggagggaaatatgttgaaaacaacaatcaaccaagtgtacaagcacgtaggtgaggaagtaacgatcggagcttgggtcgctaataagcgttcaagcgggaaaattgcgtttttacagcttcgggacggtaccggttttattcagggtgtcgtagtaaaagcggaagtggaagaaagcattttccaaacagctaaatcagtgacgcaggaaacgtcgctctatataaaaggaattgtcaaagaggacgagcgttctccgcttggatatgaacttgctgtgacaaatattgaagtcattcacgaagcgaccgattatccaattacaccaaaagaacacggaacggaatttttgatggatcacagacatttatggctgcgttcaaagcgccagcatgcgatcatgaaaatccgtaatgaaatcattcgcgcgacttacgaattctttaataacgaaggcttcgtaaaagtggatccgccgattctgactggaagcgcacctgaaggaacaacagaactctttgcgacaaagtactttgatgaagatgcatatctgtctcaaagcggacagctctacatggaagctgcggcaatggctttaggaaaagtattctctttcggaccgacattcagagcggaaaagtctaaaacaaagcgtcacttaatcgaattctggatgatcgaaccggaaatggcgtttgtagaatttgaagaaaatctccaagtacaggaaaattacgtttctttcatcgtgcaatcagttcttaaaaattgcaaaattgaactaaacacattgggaagagacacgtcaaaacttgagcaaatcaaagccccgttcccaagaattacgtatgatgaagcgattgaatttctgaaagaaaaaggctttgacgatatcgagtggggagatgatttcggagcgcctcatgaaacagcgattgctgaacattatgacaaaccggtattcatcactcgctatccgacgtccttaaaaccgttctatatgcagccggcttctgaccgtgaggacgttgtgctttgcgctgacttgattgcgccggaaggctatggagaaatcatcggcgggtctgaacgaattcacgatatggaacttttggaatcgcgtcttaaagaacatggactggattctgacgcatataaatggtatgctgaacttagaaaatatggatcagttcctcattccggcttcggccttggattagagcggacagtagcttggatcagcggagcgcctcacgttcgtgaaacgattccgttcccaagactgttaaaccgtctgtatccgtaatacattcaaatgaaacaaaaaagagtctcctgcaagggagactttttacagtaaaggggcaatcacaatcctttacagtaagaggtgtgacgatgaaaaaacagcaatttattgatatgcaggagcagggaacatcaaccatccccaatcttctgctcacgcattataaacagcttgggcttaatgaaacagaacttattctgctgttaaaaattaaaatgcatttagaaaaaggatcatattttcctacaccgaatcagctgcaggaaggtatgtcaatttctgttgaagaatgtacaaacagattgcggatgtttattcaaaaaggctttctgtttattgaagaatgcgaggatcaaaacggcatcaaatttgagaaatattctcttcagcctttatgggggaaactgtacgagtatattcagcttgcacagaatcaaacacaggaaagaaaagcagaaggggaacaaaaaagcctttataccatttttgaggaagagttcgcaaggccgttatcgcctttggagtgtgaaacgctggcgatctggcaggaccaggatcagcatgacgcacaactgatcaaacacgcgttaaaagaggctgtactatcaggaaaactcagtttccgctacattgaccggattttgtttgaatggaagaaaaacgggcttaaaactgtggagcaggcaaaaatacacagccaaaaattccggcgtgtacaagcaaagcagaatgaaccgcaaaaagagtataaaaggcaggttcctttttacaattggcttgaacaataaagtgaaaaggtgacaatcgtgttaaatctaaaacaaattgaattctgtttagacaagataggtgacatgtttcctcatgcggagtgtgaactggttcattccaatccttttgaattagtggtggctgttgctttatctgcgcaatgtacagatgcacttgtaaacagagtgaccaaaacattattccaaaaatataaacggccggaagactatttggctgttccgctggaagagcttcagcaggatattaaatcaatcggtttatatcgtaataaagcgaaaaatattcaaaagctgagtaaaatgattattgaagattacggcggagaagtgccgagagaccgcgatgagcttgtcaaactgccaggggtcgggagaaagaccgcaaacgtagtggtatccgttgcgtttggcgtgccggccatagccgtagatacccatgtggagagagtcagcaaacgattgggcatttgccggtggaaggactcggttctggaagttgaaaagacgctgatgcgcaaggttcccaaagaagattggtccgttacgcatcaccggcttattttcttcggcagatatcactgtaaagcccaatctccgcgctgtgcggagtgtccgctgctttctttgtgcagagaagggcagaagagggataaaaaaggactggtgaaacgatgacgcaagcaaaagaagtgttggcttcctatgagcaatacttgcgcagtcttggccagaagagttcctcggatatgaagaaaaccttgcagaccaatcccgtgtattttgatttctgcacggaattacaaggcgatttgccatgggaggacagcgggaaatacgttccgcttttatttgaagtgtgggatgacatcaaagcatcacttctcccagtctttcaaacacgaaaatcgagatgtgaccaaaacgaaatgttaaagggcattgtgtgtttgctggcttcgttacattggacagcaggtgagccggtgaaatcgctcgattggcaagaactgagggagaaatcatatcccgcaaagccgattaattgggctgaacgagtggaatttattcttcttaagccgacccaataccattgctttattcagcttgatgagctgattaccgaaatgaaaaagcacttttataaatatcatgcgatgaatcgataaaacctcctgataaaacgggaggttttttattgtgtaccaaaaaagccatcaccccaaaggtgacggcttttttggttaatttgttttttcaattgatgatgagtttgtttgtgttttattagatgtgtctgttttatttttattcgtgtcagtacctgttgagtcattcgtatctgagttcgaatcaccatccgacatatcctggttgttgctgttattactgttattgttattactattgttagattggtcttggttactgttgtcagacggattggtgttcgtgttgtcttgttttttgtcttgatcatttgttgaatcatctgtctgatcttgatccgtctgaccgtcatctttttgagaatcatcagtttgtgtatcatcctgagtcttctcatcatcttgtttttcatcatccgtttgttgctggtcttttttatcttcatcgtcttcagcttttggcacctcataagatgtggaagctgtacttttgccatcatcactgacggctgttacttcgaatttgtacacagatcctggctgcacacccgaaatgactgcctcttttgcagagctgttttgaatttccgagtagctgccgccgtcaacagattgctttacagcaaaggtcgcatctccgtcataattccagcttaacgttaaagattgattgtctttatcgtatttcacgtttaaaccagacagtttagctgtttcctctttttcttctttctcatatgttttagaaacagtagaaggagctgtgcctttaacaaagtactctgtgagcttcttatcgcttggcgtatttggccctgccagttttgcagggtttgagcctttttctacagaggcttccactacgctgtcaggcttctcaaatgatccgcttccgtcatcgacatcggcgatgagctgggcgaagatgcgctttgcaatctgttgctctgttttatttaaagatttttttcctatcttattttgagaatctacacctgtccaaacagcagcggtatattgaggtgtatatcctacaaaccatgaatctggtacaccgccttgtgcaatattgtatttttgcatatccgcttcatcaaagttggttgtacctgttttacctgcaacttccactcccggaacttgtgcaagctgtccagtacctgttttaacagctgttttcagcatatctgtaatcataaacgcagtataatcgctcattgctgactttgattttggtgttaaatcaagctttgtgccatcgttaaattcaatagactttacaaaatgcggttcgttatatgttccgttatttccgaatgcactgtatgctccagccatagttagagtagagacaccgggattaccttctccgaatccaccgatagaatatgattcatacactttttctttatttaatccgagccccagtccattagcaaaatcaactgctgcatcttttccgactgcttggaacgcttttagagccgggatgttacgtgattgggcgagggcttcacgcatagacatgacccctttataggaacggtcaaagtctcgaataggtgttccatctgaatacgtgtaagctgagtcatcaatttgctcgtaagttgaccattttttattttcaatcactggaccgtagtcgagaataggtttaatggtagacccaggctgtcgctgggcttgggtcgcgtaattatagccaccaaccgtagaatctcttccggagccaatcgcccgcacttctccggttttcgtatcgagaagggtaacgccgccctgcatgccttcagtaaatccgacggtgtctccgtccattaattcatctagtttatcttgtgcttttgtatctaatgtcgtatagatctttaatccgtcagcagatggatcgacatcagatttttcatcaatttccttcataacctcttcaacaaatgcgctgtatttgtttgtacttgctttttcatattccttctgtgacacgacgccttcgtctttcactgccacttttttcgctttgttatattgagaatcagaaataaatccttgctttttcatcagactgagtacgatgttccgtcgtttttccgctttatccgggtttttgaccgggttgtacgctgttgggctctgcggcattcctgcaagcgtcgcagcctgttcgacagtcaatttgcttaaatctgtaacgccgaaaaattcttccgccgcttttccgattccgtatgctctaggagaaaaataaatccggtttaaatacatttctaaaatttcatctttagagtaattgcgctccagctgaatcgaaagccatacttcctgcaccttccgtttcaacgttttctgatgtgaaagaagggagtttttgacgacctgctgggtgatcgtacttccgccttcagccccgaagccgtctttaaagttggcaactaaagcaccgccgatacggacagggtcaatcccgtggtgctcataaaaacgagcgtcttctgtcgcgataaaggcttcttttacaacatcgggaatttcatctatcgagacgtaggtccgtttttcggcgccgacttcggcgatctcttttccatttttatcataaatcgttgatgaataaggcgtcttcaatttgctttcatcaagggacggcgcatcagaaaccatgacggcaaatgtaacagcaccgccgactacgcctaaaacaaacagaatgagtaaagtgaaaagggtctttttaaacaatccgcccttttttcgtttcttgccttttttcggtgaaggactcgacttgctgttcgcttttcgtcgagcttcacggctgttaaattgatctgacataacatctcaacctttcgttaatcaacctttcgcaccagatgatggcgaaaaataaagctgttcaataatactaatataatcaattctgggtgcgtatccaagagaaatcggataagctgtttcttccaactcatcttttcgaattgattttctgccgtttttttcttttctgtcccagaaataaaacagcttatcggcttccaaaaaataaacctggtcgaaagcggatataataacaaaacaaataccgtcttgagcctttacctgcttcatgtgctcgatttgatggtcatgaaaattctgcagggggaaagaggtcttgtttttcgtttctttcgcctcaaaatcaatataccgccctttgtaaatcccattgtagtctgttgtcgatgattgtttaaagtaagcttctttaatcactgcggcacttctttttggataatggacatttacaatttgaacaggtgtcggctttttgtgtataacggcaatttggtttgtcagataatacttattcgtttcgtttaagtcatcttcgagggtcattccgcgattactgtaagacggggcccttttctgactgttttgggatgaaaccgaatgtttcggctgaaatgtttttccgttaggataccgaatcactttctcatcctccttattaaactaatcatgacggaagtgaatgaacgtgcaagaacaacagaccattagaaagcttctgagccggattgagcggcagacaaaaataaaaaacgcggataacatttcaagaacaaatgcttataaagcattttacgaccgtcatccggaaatcaaatggtcactcttggcttctttcgtttctcgtaatgccggctggtcaatgactgacttaaaaggcagtctgtttcagcttggactccgtgagagacagcaaaaatggttctttttagcctatgaaagagcgaactggcttattttttcggatgcctatccgcagcttcttttataccactggtcaaaaagagttgggaagccgctgtttcatctgctgcatgtgtttggcgtctcgcaatttatgtcggaagaatggacccgtttttggcatgagcgaaatacggagcggctaatgtacgccctcattataaatgaacaaaacactatccaaacacctattatacaaaatccttcgtttaaaaagaatgtttttgacacgattcctttttatttaagtgactggtttcattttaacaccgttatttttccttcctcaaatgggtttttttacggcatttcagtgaaacgcttttcgaaggcggaggaaaggataaggctgggaaagcagctgtctcaattgctgttcaagccagaattgttctcctctttttatcactttttgcacacagtgccgcacacaggttcccgttttgatatggaaaagatgatcgggattacaaaaagaacatctcctatgctaaggacatgctaccctgagttaatccactcattagacggaacgaaaacagattggtttcatggaaagataaagaaaacgttctttaggcgcgaggaattgccgaagcagattgaattgacagactggtatttacataaaaagcgccagcttcatgcgctttttgcggtggagcagtggctcaaaaaataaagaagcaaggaaattccttgcttcttacgtagaagggcggttcgggccgcctaattttttatctaaagaatcgattgcctttgattcagtctttttttgctggccggcttttttcggtcttgttttcatacggcacctcctcacaagtatcgtttgcattaaggaggaggatcatacaatttttgcgggtgtttttgtcgaaaacttcagcttttcgtggaatacctgtttgtttggcgatttgcttctagttttgtcatgaggaaggaaagagccttgagagcaaagaattttaaccgggagagacaaggaaagggaggtacacgaatgtccggttatgtatgcaagacagatattctccgtatgctttctgatatagaagatgaattaacgcgagctgagcaaagcctgaatcattctgtaaatgcattagaggctgagatgcgggaaacggaaaacgatcgcctaagtatgctggaagaagaaatcatagatcttcatatttgtataaatgagctgtatcaatcgcctgaacacaggtatgcgtttgagaaggtataccgtatcggctgaatttgcgagtgaaatttggtacgataggcattgaggtgaaagatattgctatcacaaactttgctggaaatgaccgagcaaatgattgaagttgctgaaaaaggcgctgatcggtatcaggaaggaaaaaacagtaatcattcttatgatttttttgagacgataaagcctgcagttgaagagaatgatgaactggctgctcgctgggcagagggtgctcttgaattgataaaagtaagccggccaaaatatgtgcataaagagcaaattgaggccgtaaaggataatttcctggaattggtccttcaatcttatgttcatcatattcataaaaaacgattcaaggacatcactgagtcagtcctttatacattgcacgcagtaaaggatgaaattgcaagagaagacagccggtaaaaggctgtcttcttttcgttgtttttatagggggccggacgttaattcatctcatatgccgggctttctgctccatttgcttcgagaaccttcatactgttacgaaactcagttatgctgagatgtccttgaatatagaggaacttggcaaagtccatcagtttattcatacagtctgtttcatatttcttcatttctgcaaaacgtttgcttaagtatgatacgttcattatggtgcatcccctctcatctgtattgaaaatatggtaccataatgattcgacttttttctgtttttaaaaaatttaaactttcgacacaatttgacaaatgctaatcatcacttgtgacacaaacaatagaagtcattcatacatatatagaagagaaatatgttgtgtttaggggggaatcgcaatgaacgggagctctcgaagctatcctcggcaaatgggctattattatcctcagcaaatgcaaggatattatcagcaggctgcacccggttatttagagcaacaactgcctcagcagcattatggacagcaggattattatcagccttatgctccgatccagcctatgcctatgcagccgcctgtattttctaacccttatcctatcccaaggcctaatcaacagcagccttcgcaatttcaaagcattatgtcgcagttcaaaaaagccaatgggcaatttgattttaataaaatgatggatacgacaggtcaagtaatgagtgcaatgaatcaggtcggatctttaataaagggatttaccagcttttttaaatgatagaagcatgaatgaatcgttcattcatgcttattttttggaaagaaaagtgtcattgtctgctcgttccaagacgtttccatatcttcttggcgaacttcataaggcagctgaaccgttcttgtcatgcttgtaaaggtagcctcattttggtgtttctgtttttcttggagtgttacatggagatacctcgatttaacatcaacgacgatctcgccatctcgaaacgtcgccggaatggtaatatcgatatacagcccagtatctttttctctgacatgtatggtcgtctgcacatcctttaaactcgagttgatcaggttctgaaatccgtttataaggttgccgaacgctgaggattggaaaagagtgtcgattgcctccgttatgatttcttctttcttttgcagttcgttctttttgtcatcatagaattccaatttcgccaccgccttttttaaccagattatgcgtctatgccagatgttgttataaattgaagcaaaattgaaagtgtggttaaatagtggtgaatgaagggataacggttgaagtgaatgagaagggagaaaatacattgctgaaaaaattattcggaatgggcaaaactcaggaaaaggtgacagaagaggttatttattctccggcagacggtacagtaatggacctgtcagatgtgccggaccctgttttttcacagaaaatgatgggagaaggaatagcggtggaaccttctagcggtgaaatcgtatctcccgctgaaggtgaagtcattcagattttccacaccaaacacgccgttggcattcggactcgctcgggaattgagctgttaattcatgtcgggctggagacagttaatatgaacggagaaggatttactgcccacattaaagaaggggataaagtgaaggtcggtgacccgctgattacatgtgatttggaattaataaaagaaaaagcgagcagcacagtcatcccaatcgttataatgaatggtgaggctgtaggatcaattgtacaggcaggcgaaaaggctgctcgtaaaggcgaatcaaagctccttacaataaaagcgaaataagcagggcgtatgccttgctttttttattcaactgtataaaatttgcacctagccatgcaaacaaatattcggtaaactgtacttgacaaagaggtgtaaagaatgaaaaagaaatcactgactgaactcatttctgatttaaaaggaaatgaaaacgttgtgaattggcatgaaattgagcctcgggaagcaaaaacaaggcctatgcccgaaagtatagacgagagaatcaaagcggccctttcgaaaaggggcattgatgaactatatactcaccaatattccgcttttcaatatgtgcaaaaaggagaaagcatcgttaccgtaacgccaacagcatcaggaaaaacgttatgctacaacctcccagtcctgcagtccatcgcccaagatgaaacaaaccgggcgttatatttatttccgactaaagcgctggcacaagaccaaaagagcgagctaaatgaaattattgatgaaatgggcattgatattaaaagctttacatatgacggggatacgtctccggcaatcagacaaaaggtgagaaaagcaggtcatattgtcattacaaaccccgatatgctgcattctgccattctaccgcatcatacgaaatgggtcagtttgtttgaaaaccttaagtatatcgtcatcgatgagcttcatacgtatcgaggtgtgttcggcagccatgtggcaaatgtgatccggcggctgaagcggatctgccggttttatggaagtgatccagtttttatttgtacttccgcaacgattgccaacccaaaggaattgggagagcagctgacaggcaacccgatgcggctggtcgatgacaacggcgcaccgagcggacgcaagcattttgtgttttacaatccgccaattgtgaacaaaccgctgaatattagaaggagcgcaaccgcagaagtgaatgaactggcgaaagagttccttaaaaacaaagtgcagaccattgtttttgccagaagcagagttcgggtggaaattattttaagccatattcaggagcttgtgaaaaaagagattggaacaaaatcaatcagaggctatcggggaggctatctgccgaaagagcgaagagaaatcgaaagaggactgagagaaggcgacattttaggagtggtcagtacgaatgccttagagcttggtgttgatatcggccagctgcaagtgtgtgtaatgacggggtatcccggaagtgttgcaagtgcttggcagcaggcgggacgagccggcagaagacacggtgaatctttgattatcatggtagccaattcaacaccgattgaccaatatattgtgcggcatcctgaatatttctttaatcgttcgccggaatctgcaagaatcaatccggagaatttgattattttagtagaccacttaaagtgtgcggcttatgagcttccttttagagctgatgaagaatttggtcccgtggaagtcagtgatattcttgagtatcttcaggaagaggctgttcttcaccgcaacggcgaacggtaccattgggcaagtgagtcgttccctgcttcaaacatcagtttgcgttcagcctcccaggaaaatgtcgttatagttgatcagtcggatattgcaaatgtaaggattataggtgaaatggaccgttttagcgcgatgacacttttacatgatgaagcgatttatttgcatgaaggcgttcagtatcaagttgagaggctcgattgggaccataaaaaggcgtatgtcagaaaagtcgatgtcgaatattatacggatgcaaacctggcagttcagctgaaggttttagaaatcgataaaacgaaagaaaaaagccgtacgtcattgcactatggagacgtcactgtcaatgccctgccgaccatttttaaaaaaataaaaatgaccacttttgaaaatattgggtctggacccattcatttgccggaagaagaactgcatacaagtgcagcttggctcgaaatcaaaacagcggatgaagacatcggggaaaagacactggaacagctgcttcttggcatctcgaatgtgctgcagcatattgtccctgtgtatatcatgtgtgatcgaaatgatgttcatgttgtttctcaaattaaagcagcccataccggattgccaaccatatttttatatgatcattatccgggcggtatcggtttggcggaggaagtctttaaacgtttttcagacattaatgaagcggcgaaacaactgattacacattgtccttgtcatgacggctgtccgtcttgtataggtacggaaatagaagggataaaagcaaagaaaagaattttgcagctgttggatcaaatgtcgtaaggagggggccggatatgtcattaaaagggaaactccagcggatgaaaaagcacatggtgctcgatgaaggagaacaaaaaatagaagcaggcaaacaagaaaaccactttgatgacatcccgtttttagaagagtgggaggcttttggcatgaagcctttcatcttcgaagatgaatactgccttatcagagaagtggaatatccgctttctcaccgccatgggttatacagcttttctgagcttgaggaagtgatcacactgtggaatcaaagcggcctgtcgcatacattgtcagcaaaagggtataacaaaaacaacctctttttctttgatacagaaacaaccggtcttgggggtggagctgggaataccatttttttgcttgggcatgcgagagtatatgaagaccgagtgacagtcaaacagcatcttttgcccaaaccggggaacgaagtcgccttgtaccaaagctttttaagcgaggttgacattacatcacttgtgacctacaacggcaaagcctttgattggccgcaggtgaaaacaaggcacaccttgatccgtgacagacttccgaagcttccggagtttggccactttgatcttttgcatggagctagacgcctgtggaaacacaaaatggaccgcgtatctcttggcacggttgaaaaagaggagctcggcatccgcagactagaagacacaccgggctacttggcgccaatgctttactttcattttataaaggcgcaagagccggatcttttaaaaggtgtcctgcatcataatgaaatggatgtgttatcgctcatatcattgtacatccatatgtctaaaaaaatcctttcagaatcacatgcgccaaaagaacacagtgaagcctatgctatggcgaaatggtttatggctcataaagaaacggatcaagcgatcaagcagttggaaaggcttatagaaaaatcgtttgaggaccaggacagtgcacggctggatttatcgctcctgtacaaaaaacaaaaccgcttggaagaagcagtgccgctttgggaaaagctgtcccgctcgcaaaaccagaagtgcagatacgctgctgtaatagagctcgcgaaatattttgagcataagaaaaaagaattcggaaaagcattgcaaatagcagagcaattgcttagcgatgcggcatgcttatcagagaaagaaactgaaaaactgcatgtgagaattgcccggctgaagaggaaatattcctcttaaatattccccgggaaagcgcaaaagacgacttgtttcgccatgaattttttttgctgaattcacattgattttgttgtagaatagcggcgaatcctgtaaaatgacgttagttatttttaaagggagagttggtatgtataagggtgttttttacttgttctttgttgtggtatttttgattgcttttgtgttttcaaactttaaagacagcttaattgcacacttttaaaataggtctttgcatcagaacatgtaccccttatttttcatagcttagtattgtaataaagtttatggaaaggggattttatcatgcatcactgcagaccgcatatgatggcgccaattgtccatcctactcattgctgtgaacaccatacgttttcgaagactatcgtgccgcacattcacccacagcatacaacaaacgtaaaccaccagcattttcagcacgttcactactttccacacactttctcaaatgttgacccggctacgcatcagcattttcaagcaggaaaaccttgctgcgactactagtatggaaaacgtgcagcttgatggtgtaaacaatgcagcacaacaaatggggcccacgggagccccattttttaaagcaggtgaaatgatgaaagtattggcaataacgggctataaaccgtttgaactcgggatatttaagcaggatgacaaggcgctgtattacataaaaaaagccattaagaaccggctgattgcttttttggatgaaggattagaatggattttaatttcgggccagcttggagcagagctgtgggcggcagaagctgcatatgatttgcaggaagaataccctgacttaaaggtagctgtcatcacaccattttacgagcaggaaaagaactggaaagaaccgaataaggaacagtatgaagcagttctggctcaggcagactatgaagcaagcctgactcaccgtccttatgaaagcccgcttcaattcaaacaaaaaaatcagttcttcattgataagtccgacgggcttctgcttttatatgacccggaaaaggaaggctcccctaagtatatgcttgggacagcggaaaaaaggcgcgaacaggatggctatcccatctactttattacaatggatgacttgagagtgacagtagaggaagacagctactcatagcaataagagaaatttgacaaccgtacagatttctgaaaaaatatatgtgatgattcacgatacgaggtgaaaaagatgcttgctgataaagtaaagctttctgcgaaagaaattttggaaaaagaatttaaaacaggcgttagaggctacaagcaagaagacgttgacaaatttttagatatgattattaaggattatgaaaccttccatcaagaaattgaagaactgcagcaggaaaatctgcagctgaaaaaacagcttgaagaagccagcaaaaaacagcctgtgcaatctaacacaacaaactttgatattttaaaacggctgtctaacttagaaaaacacgtttttggcagcaagctttatgattgatcacgcttgaaaaaaatggcgcttgtaaattgtaatcagttgttatataataattcatgttcttaacgttcgggtaatcgctgcagatcttgaatctgtagaggaaagtccatgctcgcacggtgctgagatgcccgtagtgttcgtgcctagcgaagtcataagctagggcagtctttagaggctgacggcaggaaaaaagcctacgtcttcggatatggctgagtatccttgaaagtgccacagtgacgaagtctcactagaaatggtgagagtggaacgcggtaaacccctcgagcgagaaacccaaattttggtaggggaaccttcttaacggaattcaacggagagaaggacagaatgctttctgtagatagatgattgccgcctgagtacgaggtgatgagccgtttgcagtacgacggaacaaaacatggcttacagaacgttagaccacttacatttaaaatgatgaaaacaagctctcccgtataaggagagcttttatcttgaaaagagaaaagttttaaaagacagggtgatacgatgaagaagtatacactaattgcaacggcgccgatgggcattgaagctgttgtcgcaaaggaagtacgagatttaggatacgaatgcaaggttgataacgggaaagttatttttgaaggtgatgcacttgccatctgccgtgcgaacctttggcttagaacagccgaccgtataaaggttcaggttgcttcttttaaagcgaaaacatttgatgaactgtttgaaaaaacgaaagcgattaactggcgctcatttatacctgaaaacgggaaattccctgtcatcggaaaatcggtaaaatcaacacttgcaagcgttcccgactgtcagcggatcgtcaaaaaagcaattgtcgaaaagctcaagctgcagtccggcaaagccaatgattggattgaagaaacaggtgccgagtataaagtcgaaatttctttattgaaagatcaggctttgattacactggactcatcagggacaggccttcacaaacgaggataccgtgtcgatcagggcggtgcgccgattaaagaaacacttgctgccgctttggtgcaattaaccaattggacgccggaccgcccgtttgttgatcctttctgtggctccggaacaatcgtgatagaagcggcgctaatcggccaaaacatcgccccgggattcaatcgcgattttgtttcagaggattgggaatggatcggtaaagatctgtggaacaaagcgcggcttgaagtcgaagaaaaggcaatttatgatcagccgcttacaattttcgctagcgacatagaccaccgcatggttcaaatcgcaaaagaaaatgcagaggaagcaggattgggagatctaatccagttcaaacagatgcaggtcaaagactttaccacaaatctggagtttggcgtaattgtcggcaacccgccatatggagagcgtctcggcgagaaaaaagccgttgaacagatgtacaaagaaatggggcaggcgttcgagccgcttgatacttggtctgtgtatatgctgacatcaaatgaaaactttgaggaagcatatggcagaaaagcaacgaagaaacgaaagctctttaacgggtttattaaaacggattattatcaatattggtcaaaagtaaggccgcagcgaaagaaaacagaaaacgcataaaaagaagacgctctgcatgcgtcttctttcatctttcagccctattctatcgttaccaacggtgagctttcgcgttgcttctcaatataatgttggtttgggacatttcagtgtgaccgtttacttgagacttagaacgtttaggccgcgtccaattgtgatgaaacagttcagaatgctgatctaatcggtttctataactcatctcaacatcactccctgatagaatattgttgataagacggataatccggagacggaatatcaagtgtagtttgtgcatgtttcggtgataacatgcggtaaagcatgtatataaaatgaaaagttcgcatacaatgatgattatttccatcagaggtgatctcatgctgaacagcgaacattttaatcttattcaaagggcgcttgacgcaacagcaaacgagctgaaggagctcgggactgattcgtctccgtctgtgatttcgcatgcgcaaactgatttagaaaaagcggtagaacatatttattcaacagaccatccttttttatcgtcgcatgtgatcaatcgtaagtaaactgcaaaaaacttggcattgccaagtttttttattgtattcatcagcggaaaatgatattattggtggtctgaatgtcgaatagttgggggttggaactaggtgacaacatcacgtttgcctttttctttaacgaaaacaaagaatttttatgaagaattgaacaattggattggtgacgtgttttacgatatccttcccgaaaaagggtttgatcttcgggacgagcaagtatttatggcttttcagctggagcgggcgtttaaagagaaaaaagtcatgttcgccgaagctggagtgggaacggggaaaacgctggtttatcttctttttgcaatcagctatgcaaggtatgtcggcaaacccgccatcatcgcttgtgcagatgaaacattaattgaacagctggtgaaaaaagagggcgatatttctaagctggctgagcatcttgatctgaaaattgatacaagactgtcaaaatcacatgaacaatatttatgcttgaagaagcttgaaaaaacaatgcagcgttctgatgatgataaatggctggatctttatgagtcgttaccgtcatttgtccacgagtcacaggcgatgcagcgcttttatccgtatggcgaccgtaagcagtacgcaaatctatcgaatgaagagtggtctgacgtaagctacgactcgtttcaggactgtctgacttgtgatatgagacacagatgcggtctgacactttccagagattactatcgcaagtcaacggacttaatcatatgttcccatgatttttatatggagcatgtgtggacggaagaatcacgcaaacgagagggccagctgccgctcttgcctgatcatagtgcagttgtatttgatgaggggcacttgttagagtttgctgcgcaaaaagcgctaacctatagagtgaagcagtctactcttgaattgtttttagaacgattgctgcaaaatgacatcagagaagagtttgcagaattgattgaagatgcgcttctcgcaaacgacgaatttttctatgttctttctgaagaatcaaaggaagtagccggttcacaccgtttagaaataaaaaatgaccagcgtgtcaaaaaggcggcggacgagctttgccgtttacttgataaaatcggtgaggcacttgtatttgagtctgaaatgtatacgattgatcaatacgagttgtcagtagtggaagaatatgttgaacaaatggcgtattcattatctctatatcaaaaggatgcaatcagctggctggagaaaaaggaagcagaatcaacttttgtcgtgatgccgagaacggtagcagaagtacttggcgaaaaagtgttttctaagaaaattccttatatcttctcttctgctacgctgtcagaaggcggttcgtttgattatattgccgacagtcttgggattcatgattatttgtcattaactgttgattccccttatgattatgacgagcaaatgagtattaatttatacgcaaaaacagatatggccgctgaacaaaaaacggctgaaacgattgaaacaatcaaacgatacaaaggaagaacgctggtgcttttcccttcttttgaagaattaaacgagtttaaagagctgtcggcggcatgggagctgccgtatccaattttcttcgaaggtgatgaggaaatcagcagcttagtagagaaattccaagaggaagaagaaacagtactttgttcagttcacttatgggaaggactcgacattcccggtgacgcattgaagaatgttaccatttggtcattaccgttcccgccacacgatcctgtatttacagcgaagcgcaacggagcgaaaaaagatccgttcgaagaagttgatctgccatatatgttgttacgtgtacggcagggcatcgggcgcctgattcgctcgaatcaagacagcggctcgattcacatttacgctggcggagaaaatgaacgcatcatcgatgaggtcaaaaaggtcttgcctgttgaaccgcacatgatgtaatgaaaaaaagctgacgatcgttcgtcagctttttttatttgtcagcgggatagccagccgccatcaactgctaaaatatgtccatttacataatctgaagcacgtgatgccaaaaagactgcagtccccccgatatcatccgcttggccccagcggccggcaggaattctctttaaaatgtcctcatttcgcttttcgtcatcccgaataggctttgtattcgcagtagaaatatagcctggagcgattgcgttgacctgaatacctgacgctgcccactcatttgcaaatgattttgtcaaaccggcaacagcgtgtttgctcgcggtgtaagccggaacgaggatgccgccttgaaaagacaggagagaggcaatattaataatctttccatgacctcttttcagcatgtgcctgccagcaagctgtgtcagaataaacaggctgtgtagattgacattcagtacgtgctgccagttctcttctgaaaaatcttccgctttttcccgatgaataatgccggcattattgacaaggatgtcgatctgcctgttttcaaacaggtcagctgcagaatcctttatcgcttccggcttgctcatgtccaatgtaaaagatgtaaatatccggccttcctgttccacaagctgctgtgtttcagacaggctgcttgtatgtgatgtgccgataatatcagcgccagccccggctagggctttggcaataccttgaccgatccctgttcccgggcctgtcaccagcgctgtttttccttctaatgaaaaggcgtcatgtagataacccatcttatttcagcccatccatcggaacgagatccatgtccgtaaatgtgtaattttctccagccatcgcccacacaaagctatagtttgatgttcctgcgccagaatgaatagaccaggcgggagaaaggacagcctgctcatttccaacaacaagatggcgtgtttcgtccggctggcccatgaaatgaaatacctttgagtccttttcaagatccagataaagataagcctccatccgacggtcatgaacgtgtgctggcatggtattccagttgttgttttgatctaacatcgttattcccatcatcagctgacagcttttaatgccatcctgatgaataactttgtacagacttctgacattagacgctgcatcatcaccaaggcggtccggtgtcagttcagctagggcggctttttgtgttggatagcttttgtgggcgcaagcggagacgaagtaaaacttcgctttttcaccgttcaggcttgaaaatgatacatcctgattacccattccgatatagagaaaatcctttgtttgaagcacatattcatcatcgccgactctaacggcaccaggctggccgacattaataatcccgatttcacgccgttccaaaaagaagtctgtttttagaaaatcacctgcatcaagcttcagttcactttgccctggagccgctccgccgatgacaacccggtcttcatgtgagtaatacatcgaaagtttattttctgtaaataaaggatccattaagaaatgactgcgaagctcctctgttgtaaagcgttttacttgttcaggatgtacagaataacgattttccattatatttcccccttggttaggatttcagcatcacttgaatgaaaatattttggtaacggtttcaaagaaaattttaggataaatagtgaaaagagtcaacggaaaataatgaattgacacattattaaaaaaactctttccaaattttaaaattatggtattcttttgttgtaacggttttgaaatcggtttcaaatatatgagatacaggagcacttgaatgaaaaagaaaacaacaggccatacaaccatcaaagatgtagctgaatgtgcaggagtttcgaaatcgacagtttcccgctatattaacggaaaaattgacgcgatttctcctgaaaaagtgaaaaacattaaaaaggcaatcgcagaattgaattatcggccgagtaaaatggcacaaggtttgaaaataaaaaaaagcaagttaatcggatttgttgtagctgacattacaaatcctttttcggtcgctgctttcaggggagtcgaagaggtttgtgatcaatatggttacagcattatggtgtgcaacacagataacagtcctgaaaaagagcgggaaatgctcttaaagctagaagcccattcggttgagggcttgattttaaacgcaacaggggaaaacaaggatgtactccgcgcttttgctgaacagcaaattccaacaatcttaattgaccggaaactgccagatctgaaactggataccgtaacgactgacaacagatggatcacaaaagagattcttcagaaggtgtacagcaaagggtatactgatgtcgcgctgtttaccgaaccgatttcctctatcagccctcgtgcagaaagagcagctgtgtatcaggaaatggcttcggttcataatgtgaacggggtcagattgcatgaaattgacgtaaaggacaaggagcagcttaaggcggcgcttcgttcttttcacaaggaaatgccggagcaaaaaaaagcgattctggctttgaatggcttgattatgctgaaaatcatcagctgtatggaagagcttggcctgcgcatccctcaagatatagggattgcaggattcgatgatacggaatggtataaactgatcggtccaggtattacaacgatcgcccagccgtcacatgatatgggcaggacggcgatggaacgtgtattaaaaaggattgaaggtgacaaaggagcgcctcaaaccattgaattagaggcaaaagtcatcatgagaaagtcactttaatcctaggtgccctcaactaagaggaggttgggaagagatgaagcttgatgcggtgacattcggggaatcaatggccatgttttatgcaaatgagtatggaggccttcatgaagtatccactttttctaaagggcttgccggagcagaaagcaatgtcgcctgcggccttgccagactcggatttcgaatgggatggatgagcaaggtcggcaatgatcagctcggaacgtttattttacaagagcttaaaaaagagggagtggatgtgtcccgcgtgatccgctcgcaggacgaaaatcccaccgggctgctgctgaagtcaaaagtgaaagaaggcgacccgcaagttacctactataggaaaaactcagctgcaagcacattaactacagctgaatatccgagagattattttcaatgcgcaggccatttgcatgtgacaggtattccgcctgctttatcagccgagatgaaagacttcacgtatcatgtcatgaacgacatgagaaacgcagggaagaccatttcattcgaccctaatgtaagaccttcgctttggcctgatcaagcaacaatggtacacacaatcaatgatctggctgggcttgcagactggtttttcccgggtatcgcagagggagagctattgaccggagaaaaaacacctgaaggcattgccgactattatttgaaaaaaggtgccagctttgttgctattaaacttggaaaagaaggcgcttactttaaaacggggacaagtgaaggatttctagaaggctgccgggtcgaccgggtggttgatacggtcggcgccggagacggatttgcagtcggtgtaatcagcggtatcctagacggtttgtcgtacaaggatgcggtgcaaaggggaaatgcgattggcgctttgcaagtgcaggcaccgggggatatggacggtttgccgaccagggagaaattagcttcttttttatctgctcaaagaacggttcaccaaaagaaaggggattattaatatggagtccaaagtcgttgaaaaccgtctgaaagaagcaaagctgattgcagtcattcgttcaaaggataagcaggaggcctgtcagcagattgagagtttattagataaagggattcgtgcagttgaagtgacgtatacgacccccggggcatcagatattatcgaatccttccgtaatagggaagatattttaattggcgcgggcacggtcatcagcgcgcagcaagctggggaagctgctgaggctggcgcgcagtttattgtcagtccgggtttttcagctgatcttgctgaacatctatcttttgtaaagacacattatatccccggcgtcttgactccgagcgaaattatggaagcgttgacattcggttttacgacattaaagctgttcccaagcggtgtgtttggcattccgtttatgaaaaatttagcgggtcctttcccgcaggtgacctttattccgacaggcgggatacatccgtctgaagtgccggattggcttagagccggagctggcgccgttggagtcggcagccaactgggcagctgttcaaaagaggatttgcaggctgttttccaagtgtaagcggaattgttttttcataaccggaggatgggagaatccacaatatgaaaatcaaggcgacaattgaacggatacctggcggaatgatgattattccgctatttcttggagcggcgctcaacacgtttgcgcctggaacagcggagttctttggagggtttacgggtgctttgattaccggaacgctgccgatactgggggtttttatcttttgcgtaggagcaacgattgattttcgttcttcaggctatatcgcaagaaaaggaatcacgttattattgggaaaggtcggatttgcggcgctgctcggcgtgatcgcagcgcaatttataccagacgatggcatacaatccggcttttttgcaggtctttctgttttagcaattgtcgcggtaatgaatgaaacgaacggcggactgtatttggcgctcatgaatcacatgggcagaaaagaggatgcgggcgctttcgcctttatcagtacagaatctggtccttttatgaccatggtgacgtttggtgtgacgggacttgccgcattcccatgggaaacgctggcagcgacagtcatcccgtttttacttggatgtatacttggaaatctggatcacgatctcagagacttattcagcaaggttgtgccggcgatcattccatttttcgccttttcgctcggcaataccttgaattttggaatgctgatccaatcagggctgctcggcatttttatcggagtttctgtcgtcattttatcgggcagttctttgtttttgcttgatcgttttgtcgcgcggggagacggtgtcgcgggtgtggccgcttcttctacggcgggggctgctgtagctgtgccatacgcattagcggaagcgaatgcctcatttgcgccagttgctgaatcggcaactgcaatcatcgcgacaagtgttattgttacctcgctcttaaccccgctggcaacagtgtgggtggataaaaaaatcaagcagaaaaagcggagaacacctccgccaaaaaatcaaatgacaatcaactgaataaaaaggctgccgcaaaacataccggcagccttttatacaaacaatttgactttcatacccccttccattagcctgtaatggaacggctagaatagggagggaatggatatggagatacatacatatgaaaaagaattttttgatcttttaaaaagaatctcacattacagcgaagcagttgcgttaatgcactgggactccagaacaggcgcgccgaaaaacggctcagaggatcgtgccgaaagtatcggccagctttcaacagatatattcaatatccaaacatcagatcgaatgaaggagcttatcgatgtcctgtatgaacgatttgatgacttgtcggaagatacgaaaaaagcagtggaactggcgaaaaaagagtatgaagagaataagaaaatccctgaggctgaatacaaagaatacgtgattctgtgttcaaaggcagaaacagcgtgggaggaagcgaaaggaaaatctgatttcagcttgttttctccttatttagaacagctgattgaattcaataaacgttttattacgtattggggatatcaagagcatccttatgatgcattgcttgatttgtttgagcccggcgtcacggtaaaggtgcttgatcagctgtttactgagctgaaggaagcgattatccctcttgttaaacaggtgacagcttccggaaataaaccagatacaagctttcttacaaaagcgttcccgaaagaaaagcaaaaagagctcagtctgtattttttacaggagcttggctacgattttgatggcggaagacttgatgaaaccgttcatccgtttgcaactacgctgaatcggggagacgttcgggtcacgacgagatatgatgaaaaagatttccggacggcgatctttggcaccattcatgagtgcgggcacgcgatatacgagcaaaatattgatgaagcactcagtggcacgaatttgtcagacggcgcatcaatgggaattcatgaatcgcaatcattattttacgagaattttatcggccgcaacaagcatttttggacaccgtactatcagaagattcaagaggcatcacctgaacagttcaaggacatctccctggatgattttgtccgggcaatcaatgaatcaaaaccttcatttatcagggtcgaagcggatgaattaacgtatcctcttcatatcatcatccgttatgaaattgaaaaagcgatttttagcaatgaagtgtctgtggaagatctgccgtcgctttggaatcaaaaataccaggattatttagggattacaccgcagaccgacgcagaggggattttacaggacgtccattgggcaggtggagatttcggctacttcccatcctatgcgctcggctacatgtatgcggctcagctgaaacaaaaaatgcttgaggatctccctgaatttgacgctctcttggaaagaggagagttccatccgataaagcaatggctgacggaaaaggtgcacattcacggaaaacggaaaaagccgttagacattattaaagatgcaacaggagaagagctgaatgttcgctatttaattgattatttatcaaacaaatattcaaatctctatctgtcataatcaaaagcctggcggcgcgtcgtcaggctcttttatatcgaatccccttgaaatacgaatgatatctaaaaaaacaaaattaaagttcgggaatttttattttcagcctatgcaagagattagaatcttgatataatttattacaatataataggaacactcatataatcgcgtggatatggcacgcaagtttctaccgggcaccgtaaatgtccgactatgggtgagcaatggaaccgcacgtgtacggttttttgtgatatcagcattgcttgctctttatttgagcgggcaatgctttttttattctcataacggaggtagacaggatggaagcactgaaacggaaaatagaggaagaaggcatcgtattatctgatcaggtattgaaagtggattcttttttgaatcaccaaattgatccgctgcttatgcagagaattggtgacgaatttgcgtccaggtttgcaaaagacggtattaccaaaattgtgacaatcgaatcatcaggtatcgctcccgctgtaatgacgggcttgaagctgggtgtgccagttgtcttcgcgagaaagcatcaatcgttaacactcaccgacaacttgctgacagcgtctgtttattcctttacgaagcaaacagaaagccaaatcgcagtgtctgggacccatctgtcggatcaggatcatgtgctgattatcgatgattttttggcaaatggacaggcagcgcacgggcttgtgtcgattgtgaagcaagcgggagcttctattgcgggaattggcattgttattgaaaagtcatttcagccgggaagagatgaacttgtgaaactgggctatcgagtggaatctttggcaagaattcagtctttagaagaaggaaaagtgtccttcgtacaggaggttcattcatgagaaatggattcggcaaaacgctgtctttagggattcagcatgttcttgccatgtatgccggcgccattgttgttcctctgattgtcggaaaagcaatgggactgaccgtcgagcagctgacttatttagtatcaattgatatttttatgtgcggtgtggctacacttctgcaagtgtggagcaaccgattttttgggatcgggcttccggtagtgcttggctgtacctttacagctgtatcgccgatgatagcgattggatctgaatatggggtttcaacagtttacggcagcattatcgcttcaggcattcttgtcattcttatttcatttttctttggaaagctcgtatcgttttttccgccggtcgtgacaggctctgttgttacgattatcggtattacactgatgccggttgccatgaataacatggccggcggagaaggaagtgcagatttcggagatctctccaatcttgctcttgcttttaccgtgttgagtatcattgtgcttctataccgttttacaaaaggctttatcaagtccgtctcgattttgatcggtattttgattggcaccttcatcgcatattttatgggaaaagttcaatttgataatgtttcggacgcggcagttgttcaaatgattcagccattttacttcggagcgccgtcttttcacgcagcgcctatcattacgatgtccatcgttgcaattgtcagccttgtggagtcaactggtgtttactttgctttaggtgacctgacaaaccgccgtttgacagagaaagatctgtctaaaggctatcgagctgaaggactggctgtgcttctgggcggtatttttaacgcttttccttacacggcattctctcaaaatgtcgggcttgttcagctcacagggatcaaaaaaaatgccgtcattgtggtcacaggtgtgatcctaatggcatttgggctgtttccaaagatcgctgctttcacgaccattattccatccgctgttttgggcggtgcaatgttggcgatgtttggaatggtgattgcttacggaattaaaatgctcagccgcattgattttgcgaaacaggaaaatctgctgattgttgcctgctcagtgggattggggctcggtgtgaccgttgtgccggatattttcaaacagcttccgagtgccttaacgctgcttacaacgaatggcattgtggcgggcagctttactgcagtcgtcttaaatattgtatataacgttttttctaaagctaaaaaatcagaacaagaagctgacctcgctgaacaaaaaacagcagtctaactccgccgcggcggagtttttttgcatataaaaaagattgttgcggcacaatgtatgcaaagaggtgatcgcatggcgtttattttatccattggaacaagtcttcctgcgtataatgtaaaccaagagaaagcggccgagttcgcccgctatatgtttcagcattcttttaaggatattgaccggctgttatcctcctttaaaaacgggcaaatccattcgagacagtttgttaagccgattgaatggtataaagaggggcacagctttgaagaaaaaaatcaaatatacatagaagaaacacttaaacacagcagagcggctgttcgtgagtgcctctctcatccggaattttttcaagaagccattccttatgagaaagtggaagctgtttttttcgtctccagcacaggcctttccacaccgagtatcgaggcgcggcttatgaatgaacttccgttttctccatatacgaagcggattccgatttgggggcttggctgtgcaggaggagccagcggacttgcgcgtgcagccgaatactgcaaagcgtatcctaaggcttttgtgcttgtcattgctgccgagctgtgcagcctgacattccagccggaagataaaacaaaaagcaatctgatcggcacctcgctttttggtgacggcattgccgcagctttattatgcggagagaaggcggaccgcaggatgtcaaagctgaagcttgcgccgaagataatggacgcccaatctgttttgatgaaacaatcagaagatgtcatgggttgggactttaccgatcaaggattcaaagtcattttctcacgagacattccgaccttggtggaaaaatggctcaaaacaaatgtacagatttttttggacaaacataagctgtcattccatgatatcagtgtttttttggcgcatccaggcggaaaaaaagtgatcgatgcatacatcaaaagtctcgggctatcgtcagaaaagctttcatctgcgcaaagcattttgcaaaagcacggaaatatgtcttcagctacaatcttgtatgtgatcaaagaccatctgcagaacggacataaaaaggaagctgaacgaggaatgattggcgcattagggccgggtttctcatcagagttgctgttattcagctgggaaaagggggcttgactcatgttttggttgttgatcgccattctcattgttcaaagagcagcagaaatggcagtggccaggcaaaacgaacaaaaggtaaagaagcaaggagcaattgaatttggcgagagccactatccgtatatcattacgatgcatatcctttttttcctgtccttaattgccgaggtgctgctgatgaataaacagccgtccagctggtggctcggtatcgctgcagtgattttaagcgtacagatcgtacggtattgggcgctttgttccttaggggcatattggaatacgaaaatccttgttgttccaggtgtagagcttgtgaaaaaaggtccatataaatggatgaaacatccaaactatgccgttgttatacttgaaattttgctgattccgctgctttatcaagcatacatcaccatgtgtctgttttccattttcaatgccgtgttgttaagcgtcagaattcgcgcagaagacaaagcattacaggaatacagcgtaaaatagcgattgaaaatcattctcaaccatgttaaaatgaatttgaaaaagattctcaatcaggatggtgaagcaaatgacaatgctgtttttgcttggagcggtttgtacatatagtgtattaattggttttgtattaaaaggaatctctaataaatctgtttgatgaatctggaacttgtaaaagttgcagattttcttttatagaagctgccgtaatggcggcttttttctattctcctaaagaaatttggtttattcttgtgtaaaatgaaaagggaatgaattcagatctttcgaaaaaggttcacacttgaaatggcacaaaggggttcagacttatgacagatcaaaacagaaaagagcttttgcataaaactggggaactttataagcaatttattgagaatcaagatgaacaaagggctgctaaactggctgcggtcatgaaaaaagcggctgatgaagaggtttatatcgcgtttaccgggcattattcagcgggaaaatcgtcactgctgaactgcctgttaatggagaatattttgccgacaagcccgattccgacaagcgctaaccttgttgtgatcagaaacggggaaaagcgagttcggcttcatacaacagacggagcgtgtgctgagctggaagggacttaccagaaagacaaggtgcagcaatattgtaaagacggggaacagattgaaagcgtcgaaatttttgacaggtatactgagatcgattccggggttgcgtatattgatactccagggatagattcaacagatgatgctcattttctatcggctgcttctattcttcaccaagcggatgcgctgttttacgtcgttcactataatcacgtgcactctgaggaaaatgtaaagtttctcagatcaataaaagaaagcattccgaatgtgtattttatcgtcaatcaaattgaccgccatgatgagacggagacgaaatttggagactatcaagcgcaggtagaggagatgctttgcaatgaagggatttcaagggaagcgctctattttacgtcagtaacagaaccggaccacccgttcaatcagatgggggccttgagagaagagttaagaagaatagaacagcaatcaaaaagcaatatgcaggctttaaccgaacaaaaagtccgtaatctgctaaaggaacatacggaaatgctgaagaaagacgaaacaggcgctccgagtttcgctgaacagcttaatatccaaactggactggtccaatcgctgcgtgatcaattggctgaggccgaaaaacaaacgactgaggcagagaagaggatgcaggaagaaatcaatcgtattttaaaaaacgccaacctgacgccttttgaaatgcgtgaattggcggctgcatttttagaatcacaagagccttcttttaaaaccggctttttcttttctaaagcgaaaactgcacaggaaagagataaaaggcggaatgcttttttctctgatgtggcaaaacgaacagaggccgaagcggattggcatatgatagacacgcttcataaactcgccaaggtatttgatgtctataccgctgaaagtgaaaagctgattcaggcctatcgcacaccgcttgatataagcatcattgaacgcgcggtcaagtatggtgcagccttttcctctgaatatgtattgcaatatacaaaagacttggcagagctcatccggaaagaggcgaaaagagaagccgcagacatcataaaggtgctctccgctatggtgaaagagcgtgtttccaaagatgtgcaaacaattaacgaccggctcgtccaagaatcagaaaaacttgtctttcttcaagaacaggcgcgtttagagaataatgctcgagagaaaaccgatcgcctgtgggctatttgggaagaagagtccgcatgcccaatgcatatagacacagaatggtttaaatcgaagaaaacaagagtggcggctccagagcagaaacaaggccgaagccagctgacggcgcagccgatgccgaaatcagaaatcaaaatggaacaagaaatgccgcttcaagaccaaatcaaacgcttttacactttgtctgaccttttaagcgaatgcagcatgttgttaaagcaaacttcagcgtttcgtgaaagggtgaaaaggcttgaggaacggaaatttacactcgctctttttggaggctttagctcggggaaatcatcatttgccaatgcgcttgtcggcgaaagagtgctgccatcctcaccaacgccaaccacagcgacaattaacaagatcacaaagccaatcaatggcaacttaaacaaaacagcggatgtagtgtttaagacagaggatgacataacggctgaaattttgcagctcaccggaataccaaaggaaccggcaggccgttccttcacagagaagtgggaaaaggcagtcaaaaaaaacaggctgcaggaagaacacgtgaaattgatcagcaatttcctgcttgcatacgagaagtatcagcagtatatacaggaacagaagaaattaacgattccgctctctgaattaaagccgtatgtagcagaggaaacaacggcctgtgctgtgaaagaggtaacggtctactatacatgcccgctcactgaaaaagggattacgatcgttgatacacccggcgcgagcagcatgaataaacggcatacagaactggcattccaatatatcaaagatgctgatgcatttttttatatgacttattatcagcactctttttcaaaaggagaccgttcatttttgcgaaagcttggacttgtgaaagaatcgctcagcatggataaaatgttttttattattaatgctgcagaccttgcaaaagataaaacagagctcgaaacagtgaccgattatgtcagcgcagagcttgtaaaagaaggggtttatgagccgcagctctttaccgtatcaagtaaggaggaactggtgggaaaaccggagtcattttacaatcagttctcaaaagtaagaaaacacttagaccggtttatcgaagtggacgtaaaaaaagcgtcagcagcgcagctcagttcggaggcagacaaactatgcgaaaccgtttttcagcttcaccaatcccagcatcagtcccgagaagagaaggaagcgcagaaacagcgccttatgctgtcatttgagcggacagcggccgatatcgagaaacggcggaactcaaaaaccatcattgaaaaagtaaaaaaagatactagagagcagctatatcacattgcacagcgattatcatattttgcaaatgatttattaaaatcggcatttcatcctggactgcaaaacggggattggaaaaagaacgtcagtaaagcgatgacaacagccttacatgaatatcaatttgaatatattcaggaaatcaaaacgcttgatgttcgcatgagcggtttcatcgaacggcatatcaatgaagaatggctggatcaatttcaaaaaacattaaacgaggacggctatttttccgtttatgcgggtgatcagcattcaaacggcatacagttgaaggaagttgaaccggaaatagaagaacgtgcttttgagcaggaactaaaagaggtcaaatcaccgaagcagttttttgagcagaaaggaaaatcggcctttatcgaagctgtacggatgaaacttacgaaaatcacagaggcatggataaaaaatgaagaagaaagcctgatctctcattacacagctcaactcagacgcttacaggaagatatgggcgaaaaagcaatcgcgcaaataacggatcaaaaagagacatatttaagaggatatgcggaaggggaacatgcgaaagagattgaaatagcgtaccaggcgtgcatctcctggaaaaattcagacaatacaataaaaatgtaaaattcagttggcttgtatttcaagtcatgatagactaaatagaaaaaagcgagatgaacgattaatgtcagaggtacataaagcaatttcagcacattcatcaaaacagcacgagcatatcaaagcatttatgcgtcttgaaaatatgcgtgaattggcgattgaagaagctgttgctaaatgcaaaaacgatgagccttatactacagatgcaattaatgaaattaccgagcaaatgaatcagctcgctaaaaaaggcatcgtcccgacaagacggcttgtatcaaaagaaatggtcagagaatacgtaagccgcatgtaagctggatgatcctgtcgcgagtgaacctcctgccggaagcatatactatatgcatccgacgtaaggggggattcatgttgggcagaacaaagctcggaaacagaaatgcacaggcgaataacaatgccaaaaagaaaaacggatttcaaacccattttgactcttacgcaggacgcgaagctgaaaagctgatcgccagcaacaaaagacacaacgattgataaatatccaaacagtatctctaattaaagagatactgttttttatttttgggctgctttatgataaaatagaaggaatgaaagaaaagggagttatttgatgaataataataaactattgctggttgacggcatggctcttttattccgggccttttttgccacggccgtacatcgcaactttatgataaatgacagcggggtgccgacgaacggcgtcaacggctttttaaagcatttgattacagctgtggaaacattccagccgacacacgtcgtctgctgctgggacatggggagcaaaacgtaccgaaatgacttgttccaagattataaggctaaccgcagcgcgccgcctgtggagctgattccgcagtttgatttggcaaaggaagcagccgcagagcttggaattatgaatattggctttgccggctatgaagcggatgactgtatcggtactcttgccgatttatttgcgaatgaagcggacattacggtcgtaacaggagacagagatttacttcagctgttaacggataaagtaagcgttgctttgcttcaaaaaggaatcggaaattataaagtctatacaaaagagactttttatgaagaaacaggcgtaatgccgaaggctttgattgatattaaagcgcttatgggagattccagtgataactatcccggagtcaaagggattggagaaaaaacagcctacaaactgattcgtgaatacgaaacgattgaccatttattggaaaatctttctcttcttccaaaaggacagcagggaaaaattcagcaaggtttaagcgatttggagatgtcgaggaagcttgcggaaattcattgctcagtgccgctggcctgcacactgaaagacgctttatttactttgcaaatggagcaggcggctgacatgcttcgccgccaccaaatcaaaggaattgagcgtatgcttgaaaagctgaacgctagagagatcgtttagatcttctctagcgttttgtattgcttttttttgctctctcctcaagctctgttttagggtcattatgtgtattgccttccaggtcgccttgcggagtaacaccgccggtcagccggcctttatctttctttttcatgttagttcacctcgccattaggatgaaccaatcatcaagatttaattcttttcattcagccgaatcgcttcttttgccagaagatcggctttttggttttgcttgcccggtatccatttgatgaaaaaaagagggaatgccgcttttaattggatgatttcttctacgaacggttgaaacgttttatttttaaccatttcaagctcagtggcgcgttccacaatatctgaatcggttcgaaaggaaaccgattgatacccgcgcgttgcacatagcttcatcccttcaattaatgcaagaaattccgcttcctggtttgtatgcactccgattggaatagagaaagattctgcttttccctcatgtttgataaaaatgccgataccggaaggccctggattaccggcgcttgcgccgtctacgtatatttctgtaggcattatgaactcctttcatcattaggtatcatttttttggctgcataggcataaggcaatgaaattaaagataccgcaaacttaatcaaatatgtagaaataaaaatatgaagccacacgcctgccggataaatgccgagaaaggcgactgcagtgaatatgaatgtatcaaacaactggctgactgctgtactgccgccgtttctgagccataaaagccgatcagaaggaaatatccttctaattgccgaatatacataaacatccagcgtttggctgaagataaaggcaagcagacttcctaacgcaactcgcggaaggaatccgaaaatcgtttccagcgctgtttgtgatatgtcgctggaagccggttcgaaaagcagcacgccctgcatgacaaatgtcagcgtcaggagcgttgagaatccgagccataccgcttttctggcttcagctggtccgtatttttcattcagcacatctgtcgcaaaaaagattgtgccatacatcacattcccgagtgtcgctgttaagccaaacagttcaactgttttgacgacttggaggttggcgcagactgtcgcaaaaccgatccaaacaaacagtcccattttgccaaatcctttataaaataaaagaacaatgataaaatgaatgatcgcaaaaaagatccaaaacgaattattaaacaagatgaaaaagcttcctttccggggtaagattggtttgattatagcataagcccggcaactaatgaatggtaaggtgattgtaatgaagctcagaccgcatttgaaaatagaagcaaaaggaacgggatccgtctcattttttagcgaagactggctgacagcacagcaggcacgtatgctcgccagagaacttggtcgttttccatacatgaaagagctagagttcgaagacgagaaaggcggcagctggacgctgaaggaattggaaaagctgacagaggagcttgctaaagagcctgatgacattactgtttattttgacggcagtttcgataaggagagcgaattggccggtctcgggatcgtcatctattattcattgggaggaacccggcatcgcttgagaaaaaataaaagcttccggctgaaaaccaataatgaagctgaatacgcagcgctttatgaagcaataagagaagtaagagagcttggggcaagcagaaattcaattacaatcaaaggggactcgcttgttgtgctgaatcagcttgacggcagctggccttgttatgatccatctcataatgaatggctggacaaaatagaagcactccttgaatcgctgaagcttactccaacctacgaaacaatacaacgaaaagacaatcaggaagctgacggcctcgctaaaaaaattctatcccatcaattcgtagaaagccacacgaaattagaccgtaacggagatgacgatattggataagaaaatgatctttaaagaactgacagaactgcacgatgaatattgcaaggactgttttattaagaagcagtttcgcaaagaatttggcaaaacttatgcgcattcattttgtatcaataaatgtacggttggtgaaaagttgaaacaatacggagatgtcttaaccaatcactaaaaataaaaaccgcagaagctgcggtttttattctttgaattcatccagctgatgctcgctgtcatctagcagctgctgttgctgctttacaaattcaggatcatcgagagctgccagctcttcagattgtgacagttctctagcatcctcaatggcttggtatgcagagtcgactaatgttttgctttggcctctcgtcgcagctcctgttgttttctgcgctgtttccaccgctagttccagccgccgcttatccgtaaagccagtctgatcctcattatgaaattctgaagtcacaaaaaacacctccgccattattttgcagagtttttttgaaatttatgtaccaaaatagaaaagaaaataaaaataagccgatataactattgaaccagaataaataggactgttttactatttgaggtatcttgatagagaaggggaacgcagctatggatgataaagacttgaagttgatccttcacaaaacatttatagaaatatacagtgatttagaagaactggcggatatcgcgaaaaaaggaaaaccgtcaatggaaaagtatgttgaagagattgaacagaggtgtaaacaaaacattttggcgattgaaatccagatgaaaatcaaataggagaggcgaatgcctctcctctatttgtcatctcatcatcatgtattgagtttagagttttacaacattagaagcttgaggtccacgattaccttcgacaatttcaaaagaaacttcttgtccttcttctaatgatttgtatccatctccttcgatagctgtgaagtgaacaaatacatcgtctccgccttcaacttcaatgaagccgaatcctttttcgttgttgaaccattttactttaccgttttgcatattgcttaattcctcctagtactgtagcactcatgtgctaaaaaaaattttgtcatcatctaactttgattcattgttaaatgatggttcaactatacaccatctgggagcacccgtcaagtttcgaaacggcttatttttcaaaagaagggtaagtttcataaaaaaaatgtaaccgcttttattaatggctgaatataaataaaaagagcacacgattttcgtatgctctcaagtacgccattacgatagcactttggctttttgtttggcagtcatcatttctgattccttcaggatatcctctaaaatcacttcagaggagtttgctaaatgaaggtccttaatgtttttcttcatgcgatgcaaggtatcttcatctgcaagaagggaagtgactgactcgagaatctcttcatgacggttcacaacgatggcagctccgcggtcttcaaagaagtttgcattttctttttcctggccaggcacgggtttgtacagaatgacaggcactccaatggctgtggcttctgtcaaagtaatgccgccgggcttggtaatcatgcaatctgtgattcggaatagctcatcaatgcgctccacatagcccagaacttttaatttgtcaccattttccgcttcaagcgcactcaaagattcttttaaagccgtatttttcccgcacacgacaaccacttgcacttggtcatctttgacaaggttttcgcacagctcttttacgttctttaatacaccgtgagcacctgccatgatcagaagcacttttttgtttggtgaaagattgtactttttatatatcgggccaaccggcatggattcttcaaattgcggcctgattggaattcccgtgatttttacgttgcttggatgagtgccgatctccagcagtttttccttcacgtaatctgtcgccacataatatttatccacgttttcgtgaacccaaattttatgaagacaaaaatcagtcataacgttgaaggtaggaatgactcttccagttcggcgtctgtattcaggcacgacgatcatcggaaatgtattaataataatatcgggctgatgttcatcgacaagttcgcccaatcttttattacccattttaaagtaaatattgaatttacgtttattatagattttgtcaactccgtaataaaacaaacgataaaactgtttcccgattgagaagctttttaaataaaggtattgagttacctctgaaacaatcggatttgactcttggtacaaattagaaactgttacatgctgaaagccgagccgtacacattgttcatatagtgttttggctacctgcacatgtccatttccgtaatttgcagtcaaaattaatactcttttattggtattcaagtaaattcacctcaatgtaatcaacaacaagcaagcttcatgcatcgtaaggagttattgtctatacataaacataacacaaatacataatcgaattattaatgcagtgaaaaagttaagctaattttaaatgatttggattccagtattttaaatttttgttatacgcagactgaatcagatgtattttatcatattttttgctcagcgtatcactaaaaaaagaaaaattagtcccattcataaggagtttcctggtaaacgtaataattcagccaattcataaacaataatgtggcatgcgctttccagcgattcactggctcgttgctgccttttgcaaaataatgtttaggtgcctcgacagtagaaaggtttcgttccaaatctctttcatactcttgaagaagcgtatttgtatcatattcagggtgccctgtcaaaaagacttgtttttcgtctttagacacaattaagcaaaccccggcttcctttgatgcggtaagaatgtttaactcgggcactgcttgaagctgttccatatttatatctgtatgccgggaatgcggcacgtagtatagctcgtcaaaacctcttaccaatctttcgtgttttgaaagaacggtatgttcgaacacaccgaagatttttttcggcatttgaattttttccacaccgtaatggtagtacaaacctgcttgagcaccccagcaaatatgcaaggttgaagtgacatttgttttgctccactccatgatttccttgagctcttcccaatatgaaacctcttcaaacgccaaatgctcgatcggcgcaccggtgataatcatgccgtcaaacctcttgtgacggatattggaaaaagtcgtgtaaaattcgtcaaggtgttctctcgcagtatttttcggcgtgtgtgtgcttgggattaaaaatgtaaaatgaacctgtaaaggcgaatttccaagcaatctgagaagctgagtctctgtttggatttttttcggcatcaaatttaatataataattttttgcggccggatatcctgatgaaatgctctgctttcatccattacaaatatatgttcactttcaagcacctgttttgccggcaggtgtgttggtatattaataggcaacgtgccacctccattatttccccgtttaattttcttcattataggaattttcacgccaattttcaatctatctatacgtgttgagggggaaacaacagaaaactctttaaataaaacgcactgacacgccttttggtttcacagtaaaatgattttcaaagatgtcagagggaattgtaatgttttatagaatgataagataaaaaacgagccatatgaattgataatgaacggacgcttatatcgttaggtttcttatgagttcttaattgatgtttacattttgaattgcgatttaaaaaaggtaaaataatcagcaccagggacataggagggacttacatgtctatttatcatatgaaggtacgtacaatcacagggaaagacatgacacttcagcctttcgcgggaaaggtactgatgatcgtgaatacagcaagtaagtgcggttttactccccaattaaagcagctgcaggaattatatgatacatatcagcaggaggggctggagatcttagggttcccctgcaatcaattcatgaaccaagagcctggcgaagaggctgacatacaggaattttgtgaaacaaattacggtgttacatttcctatgttttcaaaagtggatgtaaacgggaaaaacgcccacccgctgtttgtgtatttgacagaacatgcgaaagggatgctgggaactaaggcgatcaagtggaatttcacgaaatttatagtggatagaaatggagaaatcgttggccgttattcaccaaatacaaatccgaaagagctggaaaacgatatcgtgaagctattagagcaataaaaagagggtgtttttgtgaaggaattgaagcaggcagagcaaatcaggacatgggttcaatctatcctgactgacgaaagctctggacatgactggcatcatgtatcaagagtagcagatcttgcagcgtatattggagaaacggaaaaagcggatttgttcattgttgaaacggcggctttggttcatgatttaattgatgtgaagctgcctgacacggtcaggctttctgtgagcgaagtatatgatcagctcgtttttttcagagtaggaaaagagaatgctgacagggtgattcatattataacaaggatgtcctttcgggacagggggaaattggcgaaggagccgctctcaattgaaggaaaagctgtacaggatgctgacagacttgatgcgattggtgctgtcggcattgcgagagctttcatgtttgcgggcgcaaaagggcatggcctttatggagatgagcaaagcgcctacgctcatttttttcataagctgctgcggctgaaagatatgatgaatacagacactgcacgggaactggcagaagaaagacacaattttatgcttcagtttgtccgccaattagaaaaagaaatacccgggattgatgccaaaacgtcgtaatagaaggcttggagcgactatgatagaataagtcacagatatgctataggaggacgatcatgaagataaaatcaattgaacctacaccaagcccgaatacaatgaaagtcatcttaacggaagagcttccagcgggcaaaagcaataactataaacctgagcaagcagaaggcgcaccgcctgttatagcggaaattcttaaaatagatggagttaaaggggtataccacgtcgcagattttcttgctgttgaacggaatgcaagatacgactggaaagacatattaccgcaagtccgcactgcatttgggatggaaagtgctgaaagcggagaagaaaatcgttctgatcaagaatcttttggagaggtaaaagtttttgtgcagatgttcagtggcattcctatgcaagttaaattaaccgatggagagcgggaagaacgcttcggcttacctgaacgctttcagcaggcgatcttaaaacttagatctgaagcttccaatgttgtgtttgagcgggcttggaaagaacaaggtgtcagattcggtgactttgatgaaatcggccatgatgtgacagaagagcttcaggcggcatacagtgatgaacggctgaaacgactgactgaagcagccgctcaaggaaagggcgaagcaaaacaagctgtacagcgcaaagcgtataaagtaacgcttgacatgctagatgatgaggactggaaaaagcgttatgcacacttggaacagatggatccgaaagaagaggatatcccggttttacagaaggcattggatgatccaaaggtgtccatcagaagacaggctgttgtgtacttagggatgattgaaacacctgatgttcttcctctattgtataaagcacttgaggacaaagctgtatcagtcagaagaacggccggagactgcctgtctgatatcggcgatcctcaagccattcccgctatgatcaagtcgttaagcgactccagcaagcttgttcgctggcgtgcggccatgttcctgtacgaagtcggcgatgaaagtgcaattgaagctttgcgcgctgccgaagatgaccctgaatttgaggtcagccttcaagtcaaaatggcgcttgaacgtattgagcatggagaagaagcaaaaggttctgtttggaaacaaatgacggaaagcagaaaaaaaggcgaatagaaataaaaaaggtgcagatcatgcaccttttttatgtgaattcactttttataaaaattatttcgaatattgttgaaaaatatccgaaaactatttatagtaagtaacaatattaatagttggagggttcaaatcgaaagaaagctatataaatataaaaacacgaaagaacaaaacaaggtgagggcggcctgattttatcttatttgcaaaaacagctcataaataaactgaaaattgtcaaaataaaatccaatcaaacaattgaaagaatttaggaggatcaccatggcagaattacgcagtaatatgatcacacaaggaatcgatagagctccgcaccgcagtttgcttcgtgcagcaggggtaaaagaagaggatttcggcaagccgtttattgcggtgtgtaattcatacattgatatcgttcccggtcatgttcacttgcaggagtttgggaaaatcgtaaaagaagcaatcagagaagcagggggcgtgccgtttgaatttaataccattggggtagatgatggcatcgcaatggggcatatcggtatgagatattcgctgccaagccgtgaaattatcgcagactctgtggaaacggttgtatccgcacactggtttgacggaatggtctgtattccgaactgcgacaaaatcacaccgggaatgcttatggcggcaatgcgcatcaacattccgacgatttttgtcagcggcggaccgatggcggcaggaagaacaagtgacgggcgaaaaatctctctttcctcagtattcgaaggggtaggcgcctaccaagcagggaaaatcaacgaaaacgagcttcaagaactagagcagttcggatgcccaacgtgcgggtcttgctcaggcatgtttacggcgaactcaatgaactgtctgtcagaagcacttggtcttgctttgccgggtaatggaaccattctggcgacatctccggaacgcaaagagtttgtgagaaaatcggctgcgcaattaatggaaacgattcgcaaagatatcaaaccgcgtgatatcgttacagtaaaagcgattgataacgcgtttgcactcgatatggcgctcggaggttctacaaataccgttcttcatacccttgcccttgcaaacgaagccggcgttgaatactctttagaacgcattaacgaagtcgctgagcgcgtgccgcacttggccaagctggcgcctgcatcggatgtgtttattgaagatcttcatgaagcgggcggcgtgtcagcggctctgaatgagctttccaagaaagaaggagcgcttcatttagatgcgctgactgttacaggaaaaactcttggagaaaccattgccggacatgaagtaaaggattatgacgtcattcacccgctggatcaaccattcactgaaaagggaggccttgctgttttattcggtaatctagctccggacggcgctatcattaaaacaggcggcgtacagaatgggattacaagacacgaagggccggctgtcgtattcgattctcaggacgaggcgcttgacggcattatcaaccgaaaagtaaaagaaggcgacgttgtcatcatcagatacgaagggccaaaaggcggacctggcatgccggaaatgctggcgccaacatcccaaatcgttggaatggggctcgggccaaaagtggcattgattacggacggacgtttttccggagcctcccgtggcctctcaatcggccacgtatcacctgaggcagctgagggcgggccgcttgcctttgttgaaaacggagaccatattatcgttgatattgaaaaacgcatcttggatgtacaagtgccagaagaagagtgggaaaaacgaaaagcgaactggaaaggttttgaaccgaaagtgaaaaccggctacctggcacgttattctaaacttgtgacaagtgccaacaccggcggtattatgaaaatctagatagctggggacactttcttttattttaaggtgtgaacatttgaaatccgggcctctctatagtatcctttacttcagatgaaggatactagagggggctttttttatgtcaatggcttatgaagaatacatgcgccagcttgtcgtaccgatgcgccgcgagctgactggagcaggttttgaagagttaacaacagcggaagaagtagaaaactttatggaaaaggcagagggcacaactcttgtagtcgttaactctgtatgcggctgcgcggcaggccttgcgcgtcctgcggctacacaggcagtcctccagaatgacaaaacacctgacaatacggtgactgtatttgcgggccaagataaagaagctactgcgaaaatgcgtgagtattttactggccaggagccttcttcaccatcaatggctcttttgaaaggcaaagaagtcgtacattttattccgcgtcatgaaattgaaggacacgatatggaagaaatcatgaaaaatctgactgctgccttcgatgcgcactgctaaatgcccgttctccgggcattttctttttgggagtacagaagatgataacaacaagctatagaccgtctgaacacaccataaaaactgcaaagcagctttctaaagagctaaatatgccatactgcggccggaataaacaaacggttgaacacctgctgaaatcagctgaacgtgatttgcttgtggtcggcaaagagcggtttgagctgtatacgaaacaaggtgccaaattcttttttcatccgaatacagcgatgttcagagccaaacgcttcttacagggggagaaagagcctatgcttcgggctgccggcttatctgaaggggatacgtttttagattgcacactcgggctggggtcagatgccattatcgcaagtatggcagtaggcaaaacgggttctgttgttgggattgaaaaaaaccatcttgtgtctgttttagtgaggacggggctgcattcatgggaaacgggtatagaagagcttcaagctgcgatgagaagaatccaggtgaagaatggtgattgctttgaacacatcaagcagcttcctgacaactctgttgatgtggtttatttcgatccaatgtttcatgaacctgtagaaacctctgacggcatcgcgcctttacgtgatttggcagaggattccgttttgcacgaaagatgtatcaatgaagcggtacgagtcgccagaaaaagcgttgtgctaaaagaccactggaaaagcccgcggtttgaacagtttggttttaacgtcatgaaaagaaaaacagcactgttccattatggcgtcattcaaacaagcccgtgattcatatcacgggctttctgttaatcggtgacctccatgacgacaaagtataataatgttaagagtgaaactgtggcaaacagagcgtcaatcatgcggaaagcctcctttcatgaaatattgtaagcgtttttacacaaagtgcatagcaacgaatctcctaatttgcatatcagtttcatatagtacatgacttgcatgttttggatgtgctaaaataagagaaacatgacaataaaatagagaggaataagcagtcatgaaattgtggatgagaaagacccttgtggttttatttaccattgtaacgttcgggctcgtatctcctccggctgcccttatggcggacaagccttccggacagccgagcagtcttgagcagaatgattacaccgctttttatgatgagcatgacctgtacgatgatgagtcggatgacaggcgagatcctgaactgctttttcaatcgtacaaggaacagctccttgacagcgctgaggatcagtcctttttaaaattcggcagcagaatcgctcctgtcattgaggatgactatcggaaagaaatcctgccaaaaatcgaaaatgtgattagtgattatttagcgacattgcaagatgatgaggcgtaccaagatgttgtgatctcaagcatgccttcagcgggcaaaacggaaaaaattttcaacgtttacaatcggacaactggagaagatcttctcagattccatgtgcgaagagaccacccgcctcatgacggctactggtttaattttcattatcatacagcagaagatggatttcaatcacatcatgagcttgggagcatttactgggaccgcaacacgcctcccaactggatgagtgcctaaaggagatgccattagacatgaaaaagtacacaatgaatgaaatggtcgatataacaaaggatatgctaaacaaacggggcgttatgatagaagatattgcacggattgttcaaaaacttcaggaaaaatacaatccaaatctgccgctcagtgtttgcatggagaatgtagaaaaagtcctgaacaaacgtgaaattattcatgctgttttgacaggccttgcactcgatcagcttgcagaacagaagcttctccccgagccgctgcagcaccttgttgaaacggatgaaccgctttacggcatagatgaaattatcccgctttcaatcgttaatgtgtacgggtcgatcggtttgaccaatttcggttatttggataaagagaagattggaattattaaggaacttgatgaaagtccagacggtattcacacctttttggatgatattgtggcagctcttgctgcagcagcggcgagcagaattgcacatacgcatcaggatctgcaagatgaagaaaaagaacaggatgaaaagcctgttgtcaactgactataaaaaaatcatttctgggttcagaaatgattttttattgtgttacactactagaagactacttttaaaggatgaaaaaaatgaaacagtataaggatttatgcagacatgttttagagcatggtgagaaaaagggagaccggacagggaccggaacaatcagcactttcggatatcaaatgagatttaatttacgggaaggctttccgatgctcaccactaaaaaactccactttaaatcaattgcgcatgaactgctgtggttcttaaaaggagatacgaatgtacgctatctgcaggaaaacggagtgcgaatctggaatgagtgggctgatgaaaacggtgaacttggacctgtatatggctcccaatggcgttcttggcggggagctgatggagaaaccattgatcaaatttcccgtcttattgaagatattaaaacaaatccgaactccagacgcttaatcgtcagcgcctggaatgttggtgaaattgataaaatggcgttgccgccgtgccattgcctgttccaattctatgtgtctgacggcaagctgtcctgtcagctgtatcagcgctctgccgatgttttcttaggtgtgccgtttaatattgcatcttatgccctcctaaccatgatgattgctcatgtgactgggcttgaaccgggcgagttcatccatacgtttggtgatgttcatatttatcaaaatcatattgaacaagtcaatttgcagctggaaagagatgttagaccgcttccgcagcttcgtttcgccagaaaggttgattctatttttaactttgcatttgaggactttatcatcgaggattatgatccgcatcctcatataaaaggggcggtcagcgtatgatttcattcatttttgcgatggatgccaacaggcttatcggcaaagacaatgatttgccgtggcatttgcccaatgatcttgcatactttaagaaaataacatcgggccattcaatcattatgggccggaaaacatttgaatcgatcggacgtccgcttccaaatcggaaaaatattgtcgttacctcagcgccggattcagaatttccgggatgcacggttgtcagttcattaaaggatgtactggacatttgttcaggccctgaagaatgctttgtgatcggaggggctcagctctatacggacctgttcccttatgcggacagactgtatatgacgaaaattcatcacgagtttgagggtgaccgtcactttcctgaatttgatgaatccaattggaagctggtttcttctgagcaggggaccaaagacgaaaaaaacccgtatgattacgaatttctaatgtatgaaaaaaagaattcttctaaagcgggaggattttaattggttcgctacagccttctagtggtttatattgtgtatatgctgttaaaaaatatgaaacaattatttaatcaaacaatgctcgatccccgtctgtcatacaaaaaacagatggctcttgtgtacgaacagccaaaggcgtttttagaaggctgtatcggcatctccggttcagttgtgacgatccatcagccagagccaataccacacggtcctgttttgtatgtgcatccccgtttgcgtttggctgaactggccttaattgctggatatattgaggaaccggccggctttatcgctaacccaaaagtgttccgcttgccttttatcgggcaatggctggatcggatggatgtgatttcagacggggattcagaaaaggtatatgaagatgtgacaaaacagctggaaaagggacaaagcctgattctttcactagatggttctattgatcctgtagaacttgcggcccgctatcatcttccgttggtgatggtggaaacgaaaggaacagataacatgcaaaagggctcgttttttaaacgcttaaaaccggcagacattgaattgtccttttcaaaagcttatatacctgccaatgaaaaacaattacgtgcataaaaaagcgcagtcgtgaagactgcgcttttctgttactgttacgaaaggaaaggcacctttacacaatagaagagcacgcagaaaaacatggcagcgctcccgcccaatacaaagctgtgccaaatggcgtgatggaaggggatctttttccaaatgtaaaagatggttccgacagagtataaaatgccgccgagaaaaaggaggctgaatcccgctccgctcagtgaagcatataaaggtttaactgcaataatcatcagccaccccatgactaaatacacgaaggttgacaataggataaaccgtttcacaaagaaaattttaaaaacgattccgcctagggcaagtgaccatacgataaccaacagggtaaagccgagtgtgcctttcagcggcccaagcaaaaaaggcgtgtaggttccggcgatgagtacgtaaattgcgctatgatcaataatctccaaaatgtccttcgtttttttatgtgtgatgctgtgaagcagggtggagctcaaatataacagcagcatagagacaccgaatattgtaaagctgacaatgtcccatgcagacccgtaattagccgcaaatatgattagaaacactaatgctgggatggataagaggacaccgatgccgtgtgtaatcgcattggcgatctcttctttgattgtaaacaagtacattctcctttcgatcgctagatcatttgattttttaacgtctctataaagctcaagccctcaaaggtaatttttgtgcctgcgcgtccgcggcttttggtgacataatcttttttctccaaatagtcgagacggcttctgacctgctgaggagttaacgaggtttgggtatttttgctgtgttcagaaatgatccgtctgctggcaggttctcctttttcgttcaatacttttattgtttccaaaataaacaaaaactcagctttttccattaaagtcagcagcttcgcttttttcttcgacgtttttccgtctatcgcgcctctaatatatggcggcaggtcatatggctggatcgttcctccgcttgatactgccgccatataatctgcagcgttttttaattccctgacattgccttcaaatgcatgcttctcaagcacgggaaaaacggagggatcgattaacaattgctgaccggaatttgagagaaaatgctgtgtcaaaagcggaatatcgctttttcgttccgataattcgggcagtgtgagcgttaaaatgttcagtctgtagaataagtcttgcctgaatgtatgttccacggatcggtctgcagaagcacagatcattcgcggtttctccgtgtctgaatcaagcgcttttaacagctgagcttgtacagaagcaggcatgcgccatacatcatcaagaaaaagggttcctcgtaccgctttttgaaaaacacctgtgtttccgttagggccaaaaagctcatgaataagggtttcttccgaatgggtgctgcaattgacgcttataaacggttcattgcttctcgaagattccaagtgtatggcatgtgcgaagtgatttttgcctgttccgatttttcctgttattaagacaggaagctccgataacgagaactgcttggcgattcgcttcgcttccagaaaagtttgatgttctccgattagatgttgaaatgtattgagttttggtgcactattcatcaattggctccttttggttctaattggtttcattatatcatgccttttggttgaaaacaccctttattttacgatcatcttttttcttggctctgcaggataatggttgaacagaagttaccacaagatgtggtggacatagtctgtatttttttaattattaaataaaaataattgtcttattttttgaatattcatgttataatggcatattaaatagggatttaaaacaagaaaggaatctgtacatgaaaccgttgcttaaagaaaactctctcatccaagtgaaagacattttgaaggctcaccaaaacgtaaaggacgttgtcattcacacacctttgcagaggaatgacagactttctgagagatatgaatgcaatatctatttaaaacgcgaagacttgcaagttgtcagatcttttaagctcagaggggcttatcataaaatgaaacagctttccagcgagcagacagagaacggagttgtgtgtgcaagtgccggaaaccacgctcaaggtgtggcattttcgtgtaaacatcttggcattcacgggaaaatttttatgccgtctactacaccgagacaaaaagtatctcaagttgaactattcggaaaaggatttatcgatattattttgacaggcgatacgtttgacgacgcgtataaaagcgctgctgaatgctgtgaggcggaatctcggacgtttatccatccgttcgatgatccggatgtgatggccggacagggaacgctcgcagtcgagattttaaacgacattgatacagaaccgcattttctttttgcaagtgtcggaggcggcggccttctctctggggtaggtacatatttgaaaaacgtgtctcctgatacaaaggtaattgctgttgagccggcgggagcggcatcctactttgaatcaaacaaagctgggcatgtcgtcacacttgataaaattgataagtttgtagatggtgcggctgttaaaaaaattggcgaggaaaccttccggacgctggaaactgtcgttgatgacattctccttgtgcctgaaggaaaagtatgtacatccattcttgaattatataacgaatgtgcggttgttgctgaaccggctggagctctttctgtcgcagcgcttgatttgtacaaggatcaaattaaagggaaaaacgtggtgtgtgtggtaagcgggggcaataacgatatcggaagaatgcaggaaatgaaggagcgttccttgatttttgaaggccttcagcattattttatcgtcaattttccacaaagagcgggggcgctccgcgaatttcttgacgaagtcctcgggccgaatgatgacattacaaggtttgaatatacgaagaaaaataataaaagcaatggacctgctcttgtcggcatcgagctgcagaacaaagccgattatgggccgctgattgaacggatgaacaaaaaaccgtttcattatgtagaggtgaacaaggatgaggacttgttccatttgctaatctaatttttttacacaaccgcgcaaaatgacagacagcccggctggcatcatatataatagaagaaaaacaaaaaagaggattgatagcttgttactcaaaagcctagagttcaaacgcggtgacgggattcaggtgaaagtgacagaaatacctgtattaaaggaagatgagcactatttctttatgttacatcaccatttgcaattctacttaaaagaagtgttttcatcaaacagcagggcaaaagtgtattctttccgacattatatgaagcggcggatgaagtgggcagattatcaggctgtatttcatcaagaggtgttaaagcacaacgcgtaacatgccgttttttacctgcatgccctcctttgtaatcgttaatggggaggcatgcaggattttttttgctcagtatcgaatacaaacatgggacagtaaggacggttttagaaagcgtttttatgctggctggaaaggatggatgtcatgaaggttatcaaggggttaacggctgggctgttttttctgtttttgtgtgcatgcggaggacagcagattaaaaatccgctcaattacgaggtggagccttttacatttcaaaaccaagacggcaagaacgtttctttagagagtttaaaaggagaagtatggctggcggattttatttttaccaattgtgaaactatatgtccgccaatgaccgctcatatgaccgatctgcaaaaaaaactgaaagccgaaaatatagatgttcgcatcatatcatttagtgttgacccagaaaacgataagccgaaacagctgaagaaatttgccgcaaattatccattatcttttgataactgggattttctcaccggatacagccagagtgagattgaagagttcgcacttaagagctttaaggcgattgtgaagaaacctgagggacaggaccaagtcattcatcaatcttctttttggttagtaggcccgaacggcaaggtgctgaaagattataatggagtggaaaatacaccgtacgatgaaattatcgccgatgtaaaatcagcaggcgcactcaagtaagctagaagactaggcatttgcaaatcttctaaaacatgatacactttccactagtagaatgggaaggagcaacaagattgaagctgcgcattttttcaatcatggccagtttgattttgcttcttactgcgtgtacgagcatacgtacatcatctgagggaaaacaaaaagcccatgaaacgaaaacaaaagaacacattgtcatagcggctgtcggagattcgcttacagaaggagtcggagatcccgacggaaagggatatgtcggcaaggtggcggattctatccggtcagataaacaagtcaaaacggtcgacgtgaaaaattatgccgtaaaagggaaccgttcggatgatttattagaaaaactaaaagataaaaaggttcaaaaaggcataaaggacgcagattatgtcttttttacaattggcggtaatgatttgatgaaaatccttcgccaaaactttctgcaattaaccgttgaaccgtttcaggaagcggaaaaaccgtacgaaaagcgctttgaaaaaatcatttctgaaattcgcgagctgaatgatcacgctgagctgatttatgtcagcatgtacaatccgtttacatttacattatcagaactaaatgaaataaatggtgtcgtcacggattggaaccatattgctgaaaaagagctgaaaaaagataaacatgcaaaaatcgtccatatcgaagatttgttcaatcaaaaaagtgacagcagccgaatttctgaggaagatgattttcatcctaatggtacgggttattctcttatcgcaaagcgcgtctatcaagccattaaaaaagaaggattaccgaaagagtagggtgacagcatgaataagtggaagcgactgttttttatattgcttgcaatcaattttatcctcgccgccgggtttgtggcacttgttttgctcccgggggaacaggctcaggtgaaggattcatctgagagcgagtatggatttcaagtgacaagcacaaaagaatcattagctgcgtttgttaactcatatttaaacgacaaagcatcaaacaagcttgattataaagtagagattgatgatgatgttcatgtcgcagggaaaatcaaggcattttccacgtctattgatgcgtttatcgcttttgagccgaccgtgaaaaaaaacggtgatgtagagctgaatgtcacgaaattttcgttagggaaattgagtataccaattagctttgtgttaaattatatggacagcttttatgaattgccgtcatttgtccatgttcaccccggagataaaagcattgaagtgcgtttgtcagaaatgcctttaacgaatggaatgtatgtcaaagcggataagataaatttagaaaaagatgaaattgagttttcctattaccatcctaaacaatagaggtgactgaaaatgaaacggatttaccagtatttcagtttattatcctttacattttccctgtacttcggctggcttgcttatcatcatctggctgctgaagatatggatcaaatgtatttgaatgtttcctattgtgccttgttcctaagtgtgatggtgtttacattcggtatgcgagaccgaaaaaaaaccgataagtcatgaaaaaagagacatgaaacaacgtctcttttttcgtgcggtccgaagaaaatttgagaacacaaggagaaaagatgaaagcatacgattttacacaggggaacgtgctgaaacagcttgtactgttttcaatgcctattatgctcggaaacgcattgcaggtttcctttcaatttatagacagcttgtggatcggcaatttactgggggcaaaggcccttggggcagccgcggtatcaagcacggttgttttgaccgtgctgtcttttattttgggccttaacaatgcaacattaacaattttatctcagcaaaaaggaaaagatgatgtaaaaggaatggcgtcgtatattaacgcttttgttgttttattaacaggcctaagcatcggattcggcgcggccggtttttttctctcagagcttttgctgcgtcttctaaaaacgccggagtcaatgataccgcttgctgagacgtatttacagattcaatttatcggcattttatttttgtttggttataactttatcagtactgtgcttcgtgcgctgggcgacagcaagacacctctccggtttattgcgtttgctgttgtactgaatacagtgcttgcgccgctctttatttctgtgttccgcatgggaatagcgggagcggcttattcaacgattttgtcacagggcattgcgtttttgtatgggttgttttatgtcatcaaacacaagcttgtgccattctcgattccgagaatgcccaagtgggaagagtccgcgctgattttgaaactcgggattccggcaggtctgcagatgatggtgattacaggcggtatgatggcgattatgagtgttgttaactcatacggggatcacgtggtatcaggctttggcgcggtgcagcggcttgatagcatcatcacgcttccagcaatggctgccggtacggccgtcaatagtatggcagggcaaaatattggaatcggaaacgaaaaaagagtgggaacaattgcaaggctaggtgtgatggctgttatttcctgcatgctggtgattgcggttatgatttgggtatttggtaaatatctcataaggttatttatcagtgagcctgatgcggtcgcatttggtgaacaatatttgaagtggatcgcgtttttctacccttttattgggattaattttgtgctgaacggaatcgtcagggccgcgggagcgatgctgcaggttctggtattaaatttaatctcgttttgggtgttgagatatcctttcacagctctattttcagcttggcttggacaaaaaggaatcgggcttggaatcggaatgagttttttatttagcagctgcgcggcatttttatattatagatatggccgctggaaagcaatgaagctgtttactgaaaaataagtgaagcactgcgaaaagcacatacctatatatcggtatgtgctttttttcaccgttttttatcaagtttgctgaagagctcgattaacgtggcaagttcagcatcagtgtagcagtcaaagcgtttaaagaaatattccgtttttttctcgttaaagtgctgaaggactttttcgcctgcttcagtgatatgaatgcggatgatgcgtctgtcttccttcgatctgattctcgtaatccattccttttctaccagcgcatcggtcacagccgtaatgtggcttgccgatacctctaaaataggcgcaaattcagtgacttttttaggcccttgttcactaaggattcgaagaatggtgaattcattccgcgacagctctttatctaaaatttcattgatttcattgcgtatttgtttaaagactttacggagtaaagtttccatatcgtacatcatctgtgttcttactttcaaatttgtgaacctccattacataagcatattgcttaaaacctatagattttattgaaaagcagaatcattttcattctatttttacatgctataatataataataccacgtattaacaaaggaggcaccagtatgtctgaaaaaaaagaaatcgccacatttgcaggaggctgtttttggtgtatggttaaaccttttgacgaacagccgggaattgaaaaagtggtgtccgggtatacaggcggccatactgaaaaccctacgtacgaagaggtgtgcagtgaaacgacgggacatcgtgaagccgttcaaatcacgtttaatcctgatgtattcccttatgaaaaactgcttgaattattttggcagcaaatcgatccgacagatgccggggggcagtttgctgatcgcggcagttcctatcgcgcagccattttttatcataatgataaacaaaaggagcttgcggaagcttccaagcaacgtctggcggaaagcggcatctttaaagatccgattgtaacggacattttaaaagctgaacctttctatgaagcggaaggctaccatcagcatttttataaaaagaatccagcacattatcagcgctaccggacaggttccggacgagcgggatttatcagcgagcattggggggctaaataaatggcgtacaataaagaagaaaaaataaagtcattaaatcgcatgcaatatgaagtaacgcaaaataacggcacggagccgccatttcaaaatgaatattgggatcataaggaagaagggttgtatgtagacattgtgtcaggcaagccattgtttacatccaaggataaatttgattcccactgcggctggccaagctttacaaagccgattgaagaagaagaagtggaagaaaaactggacacgagccacggcatgattcgcacagaagtaagaagccgaactgctgattctcatcttggccacgtatttaatgacggacctggtccaaacggacttcgttactgcataaattcagcagcgctgcggtttgttccgaagcataagctaaaagaagaaggatacgaaagctatctgcatctctttaataaataaagtgttaaaaacaggcctgcctaatggatagacaggcttgtttttatgcctttttctcttgatgcaattcttcaataatctgagcaattctttctttcgtaatgagcggggcttgatctgattgatacccaggcagattgactttgcgaaagtcaggatgtttttccggctctggaaggatcgcataaaggttgccccattcatacagtgattcaatttcatgtggagatgttaattcttcgtgaagcttttcacctggacgcttgcccacttctactgcagccggccgcgggagcccgtgctgcgatgcatattcttcaaacccatgaatcagttcttcaagtttcagtgattccattttgaaaataaaggtttctccgccttttgtaatagcagccgattgtaatgtcaatgtagctgcatcgtctattgacatgaaaaatctggtcatgtttttgtctgtgatggtcaggggttcaccctccatcatctgttcaaataatatggggatgaccgaacctctggaaccgagaacatttccaaagcggaccgaacaaaacaaggttcctttgttttggacgtggcggtttgcttgatgaaacagcttttcagataacagcttggtggcacccattgtgttcacaggagatacagctttatctgtttatcaagataatgactacgattcgtagctgctgactgtttccccgattaggaagttatatcttagaattggtgtaatttcaaattgtgcaggtattgggccttttctttttgctgtcattttaactataactttctgcagcataattctgagcagtttgttcttttcttctctgttttcagatgactcatatagttcaattgcattttttatgttctctttaagttggttgatatcaagaccacctttaaaatcaacaaggtcatttatctcgtcttttgctttttttagctcttgcagctctttgtctaagactgatttccgctgcaggaatatttcatcagagtaaatgccactttcatatttatcgaatatgaaattcaatttgttttttaactctttttctcgctgctcaaactgttcattcatttgcttttttgatctgatattgtttttgttttcatgagactgaatcacactaccaagatgtttcgtaaggtcattgtcatttagcgcctgtagatactttaaatagtctagaatggcttcttcaacatcattgtatcggacattcatacacttgttattgaggcatctgagcactttaacgtgatataagctttctgtaccgtttttattttgtctctttcttttggcttcgtattttgacaatgggccaccgcaatctgcacaaatacatactccagccaattcatttaatttataatcgcttctatttggcagcaaaggtattttgttttcgatttttttatttgcctcctggaattgatctttatcaattataggagtgtgtgcgtcaggtacaattatttgttcattctcaggtctaattgttctcttgccgtctttttctttctctctgactttatacttaacagttcctatataagcttcattttcaagaatggcttttacagtgaaccgattccattttttctttccggcaggggaggggatttgcagattggttaaatgagtcgcaattgcgttgtaactgtaatcctttccatttagaccgttcaggaataaatcaaatattagttcaacaacctttgcttcatcctcaactggatctagtttagacgtctttttgtttaactggtatccataaggtgccagtccagatatccatttcccttgagctgcataagtgtatttagcgcctgtcatacgctcccttgtcatttcaaattcttccctagccataaataattcaaaacgaatctggcgcatgtctacagggtttctagggtcataaaccttatatggtgtaattatgatcaatcgtttgctttgaagaaggttgacaatctgtcctgcatcgctataactcccacgactaagtcttgttatttctttaacagcaattgcctgatatttgccttcctctaaatcttttaggcattccttaaaaacagggcgcccctcaatgctttctcctgatccaatctccatttttaattcatacgggatttcaatggctgtaagtattttattcatgagttctttttgttctgtgagcgtgtcttcacctgttcttttttctcgttccatgtcctgacgagaacgtctaagataacctaaaatatttgtgatgttgtaagaattgacaatgttttttaactccaaaaatttagcacctctttattgtgtttaatgtcaaaacagaagtatctgtaaaaacattctatctaacattgaatacgaaaacaacaaaatagtttgaaagatttgtattctttgaatgttgatctatctggttttaaatttggtcatatgtattatgaattattattcagctctcgtcttttagagatgggttattttttttgtccatttttgcgcggtacttatttggcgtgcatattatcggttgtaaaaaaagttttacttcggatgtcgcaaaatcaaatatatcgatggggttttacttacgaaaggcgaaaaagatgtgccattccagaagttaaactcgcagttattaatgacggaggaatttttcgctgaattgtgcggatagcaaaagtcacgggtagtatctattgaaggatataagagggggatgaatcgttgactatgagtaacatttggataaaacaaggctcttctaaaaccttgttaaatatctcaactaactatctataatgcttgtgagcaaaattgtacgcccttgcttaactctcaataaaaatctaatgaaattataggaggaaagaataatggatcaaacacaaatcgtaattttatcactaatcatcactgctattggtgagatcaaagatctattaattgctatgttcccgaagttgtttccagcaatcggaacattcttgcttggcctgaacatttatgtatgggtaataatccttctgctgctgattattgctattttaatatacatagttattaggaggtgatctaaataaaattcccattttatttaaacccgaaagctgcttgaatacatcgcaaatataaggtaccctgtatatgtatcataggggtttaacagccactataacaccagagagctccctcacatagctctctggttcttttaatttataggctgtttttgcataaagaccatcgtgaagatgaaaattttaaagatgaactcaaataatctaagggaataaaatagtgaagttgatcccaaatacgcaaatttcatacaataagtacatactaatctgtttattaaactttcgtgtagagctgggtaagtaaatgttcttatggtttcggtcattaagggagtgcaatttataggatgaagaaaaatcttatggtaattaattaaaagaacaggagactatgaatggaattcttaattagacaagaactcacacatgaatataatacgactgaagaaattgttaaaagagcttttttaaatgaagaatatagtgacaagaaagagcatttacttgtaaataggattagaaaatcagatgcattcattcctgaactttcattggtcgcattaaatcaagataaagatatcgtaggccatgtccttttatctaaaataaaaatcattgatggcgataacactgtcgattctttagcactcgctccagtttcggttgcgcctgattatcagaaaaaaggaattgggagtaaattaattcgtactgcgttaaaaaacgcaatagagcttggttatcgttcagtaattgttttaggacataaagattattatccaaggtttggttttaagccagctagcttatggaatataaaagccccatttgaggtgcctgatgaagtgtttatggctctagaattagcagataattctcttgaagatgtgcaaggtatcgttaattattcaaaagctttttttgagtaaaaattagatgattgattagatattttaaaaagaggttgtcccgagaattttttaatctgtggatagcctctttttgtgtaaagagccctaaaaataaaaaagaaagccacaaagggctttcaattagcgttcacatgcatagttgtcatgatccctgtccattttagattggtaagcagggtgggagctaggcactccattcggatatttctttcttaactctgtgcaatttttaaatgcttctgtttctccagttgtctctgaagaagcttctttttcagttgtagtcgaagtttcacttgatgcttttggagtagtaggctgtttagctgccggtttagatgttgttgcttttttaactgcagtggttttctctttcacacagccattaaatcctcggtcggtcacatatccattcttgctccagattgaaagcttctctgattttgcttcctgctcgtctttcttaaattggtctatgtatttggtgtttggctcatatacatacgctactctggccaatccttcttttagcaatgtttcctgaacagatttgccatccacataaacataagctaatagtcttccgtatttatctctgcggtcacctttatcgaactccagttgcagcttaccactgttgaccaattccttgtttcgcttagacgcatcttcaccatatggttgaacacaagaatttggtttcttagtttcaggtgtatcaacgagcaagtagcggactgtatctacatttccgttgtaggtaactttaatcgtatctccatcaactgctctgtctaatgtaacatcgaccaattcctttttgtcttttaccttagatttgtcagcagttttttctttagtagattccttttgttccgttttcttttctacatctgtagacgcttgtggtgtttctttttctgtgcttactttttcagaatcatttgagctgcaggctgccaatgataagctcaaagtgaatgctgcaaaacctaataatactttcttcaacttcatttccccttttagaatgtttgttctctatttatatcggtaaaccatcaataattataatcctatatccaattattgtgaatttaatttttccttaatatcattgcatttccctttaaaacttccaggcgcatgttaaaatttcactgaattcatagtcaaaaggggaatgtttttatgcttggaatcaacgttgaaaaattaaatgaatacttaattatcaattggcagctatccagaattgaaattccaatcaaagaaatcaatgatgtatttcttgatccaaactatgggggagaggaaaaaagtgcagtaaggattggatttccttatggctctacggatagggtagtgattaaaacagcaaataacacttacattttgttcaccactaatgctgcttctattatgagtaaaattgtttcctaataaccaagtgatgtcctattagtaatgctttccttatagctgtatgacatggtaaaatctagataattgttgatagggggatgggatatggaagaaggcaaacttattcatttgacacttgctggtattaaagaagctgtttctaagtatggcacttttccaatgattcaaccaggtggtttcgtattagaagatgccacatttgaatttaatgaacctgcaacagaagaagaaattagaaaattagaatcacatttcaatgtaagtttacccaaagattataaggagttcctagctctacataatggtttggaatttcttgatggaatcgaaatactcagtattgaagatgttatgaaatacaatgaaacagaagacctaccagaaaagtgttttttgattggatatcattttgatggaaggtatgttatagattcaaatagatatgaaaaaggggacttaaattacctattttatttggattcgattgatcattttgatgaagcagtggatttaaaagcgaattttgaaatttggtttgatcgacttttaagttcgaacggaaataagtactgggaagttgaaagagatgttaaagcttattatgaaaatatagatgagtaaaggactctgattaaagtcctttactacttttaattaataagaagcccaccatggattgacctctgttctatggaagctccgatccaaaggaattaaattcccagtcatatttccgccaccgtattcccttggaagttgatggtggatttcaaacttagtccaagtttttttgccatatttcttatcgtaccaatttctatacgctgtacgttctttatttccccatttaactcttttctcagaaggaatctttttccagaaaatatgtgatggtgctaatagatttaatcccgattgtttgtcagtatagacagggaagaacatgccttttttgtttgtaaggtataggccttctgtccaagttaaagttctaatggaagggggtcttcctgcccaagttgcgatagcacttcctgaatacttccaaaaggctgaagcattgacattaagcagttgatgtacttccgcacctttttttatttgacctgcaacgaaagtttttcttattacgtgagggcatgtaaattgtttgttgtaataaccacttttacatagagcttgttgaacttcaagagttgcaggaggtgttccaacaacttttgtaacctctactccatgaattactttattgacctttccacctaaaaaagtatgaccgagataaactacattcccagctttcttttcaagggtttttcgttggttctcacttgtaacgtttcctgatgaaagtttgtttccttgtttgtcgtaggctatatatgtttgataggaatctgttacatcaagcccttcttcttttgcaattttagcaagtttgctagaggtgccagtaatctcttttttgggacttgtttcactgaattgctttattccattaactgaagaaatacgttgggtaaggtcgattccttggatgcttgttttgtcagatgattcacttgcagctactttcttttcatgtgtcaagagtccagaaagaagtaaaacaacagttagagcggttaatccaaagcattttaaaaactttttcataaacaatcatctcctttttctgtgttattaacaaatgaataatcaacgagtgttaaattgttgcaaataattacatattatcccacctccagacaggatcatatcaaatgacctaaaaaattacaattgatttttagagagttaagaaatatttaaagttgtaaattcctaggttaattggttgtgtactaggtgatggcatggggatttgtggtaaaatttatatagagtaagcttgaaaggagaatgagatgaaggtatttgaggctgattcattactctttgaggccgataaaagaaccaaagagtataaggaactaaggtcgcaaatggtgaagctaagaaaagcttttcaaaacgtagctaacctagatgacagtgagttttcaggcaagggtgctgacaacattaaagcgttttatcatgatcatgtcggtgttactgatcaatggattgatttaattgacatgaagattgctttcttaagcagcatctctgcaaaacttgaagatgctaagatgtctgatgcttacatagaagaatcctttttagaacacgagttggctaactcctatacaaaatcaaaatccattatgtctgaacagaaaaaagcaatgaaagacatattaaacgacatcaatgatattcttccccttgaaatattttcaacagaagacttcaaagacaaactttcttctgcagatgacaaacgtgaaaaaacaattgataagctaaacaagcttgatgagaatttgaaaacagaatatgctgaaacagagcctaacgaacaattcattcagcaagattttaaaaagctgcaggagtcaacaggcataggaaagaacgctacaccaattcactacaatgccaaagcgtatagagaaagtgacatacataagaaaaaaggcgatattgagaagcattctgaagcttacttaagcgtgaagaaagaagaagctaaagaacgtgaaataaaagaattaaagaaaaaacttaatgacggtgtctctgaccctgatgaatatttagagattgctaagaaagtagggtacgataatctggagccagctcaagtacagcttgcagtgcaaattgaacaagcgaagcagctagaaggagcaggagaaatcacttgggacatcgtaaaaggtgtaggagttggtttatacgatgtaggaaaagacactgtaaccggcatatgggatttcatcaccgatccaggagaaacactatcagcactgggaaatgcagttattcatccagtgaaaacatatgatgccatttcagcagccatagaagagtcatatcaaaaagatatggtgaatggggatgcctattctagatcaaggtgggtaacctacgctgttggttcagtggctgtagctgtttttggaaccaaaggtacaggagccattaacaaagctgatgcagcaggcaaagtaataaataaagctagtcaagcagggaagaaaattaaggatgtcaacatttcagatttgttgccttacaaccctaagtacgatcttgctatggcaggggacgtgccatacaatgtagtggatggagaaaacctaaaaaatcagctaatgagttttgctaaagggtcagataaagaagtaaaacctttcgatgtcgttgattatagaccaagtaacagtcctttagagaatcatcacggtgtaatggacgtatgggctaaacacaatgttccgaattatgtgagtagagggagtaacacaccaacagtagctttaactaaggaacaacacaacgctaccaagaaagtatatagagaatggttgttcgaaaaaacagggaagaaagttggcggcaaagtaaactggaaagaagtatcccccagagaaatacaagaacttactgagaagatgtttgatgctgctaatgttcctaaagaagctagacagcaatattataacgcatttaatcaatacaactttagaaagtaggtgcggacttgagcattgatatgttaatcaagaagattgcttccacatcagactgtcggctgtttgaagctgatggtctcccagtaatagacgagaagcatcaactaccaaaagatattagtgaattttatgaacaatgtggtggagcagttttatatgaaaatgcggattatccaatatacatagtacgaccagctgagtttgaattagctaatcccattattgttggggagctctgtgaagaagacatttcatccgagtggtatattgtttgcacggatggaaaaggagaatacctaacaattgacttaaacgatcagcgaaaaggaaaatgctatgacagtttttttgatcgacatggaatagtcggcgaaacacaggtgatagcaagttcatttacagatttaatacagcgactgcttgaaaataagggtaaacattggtattggttaagggatgattatgtatcactaggcgatgcatatgatggcatagaaattgaataatctattaaacaaaagtattgcaattgtttattgctaaagatgtgcaatgcgtagggtattaaaatgagctttactaagatcgaacaaaagttgaaagagtttacgattgatgctggcagataccctagcattaatacaaatgaacaactcaaagagcttgaaatgaacataggcaatcaattaccttcagattataaggactttttgaagaaatatggaggatgttatttagaaagtaaaaaaacaacagatgagattgagtatgacgtttgctataaacctttagagaaagatccttggatgggcaagggcgatgatacacaattgttagaaggtttttatggtttagcgaacgatcataacagtcttcagaaagcaatcgatacatattctgatcgctttcctagaaatattattcctatcgcaagctctgcaggcgggaatgaaatatgcatggatatcgataatggaaagatattgttttgggatcatgaattaagtcatcccgacaaagactttttcttaattgccaattcgtttgaggagtttgtcttcagtttagttgatgaaccaattgaagctgataaagaagatgatggaattctgtatattgaattagatgatgacttactaagcagttaagaaagcgtatggaaataactggaggaaaagttaaaatggcagttagttattggacaggggagaatcttacactgcgagcaattcaacctgaagatatcgttatatttgattcgttagatgatgaaattctgcgaaatatggactcgctacattttcctcgttcagctaataacatgagagaatgggtagaagaacaattagaaaaagatgaattccgttttattgcagttgatagtgataataatatagtaggtataattgaaacctttgactgtgataggaaaaatggtaccttcggttattatttggctgtattcgagccatataggggaaaaggatttgccaaagaaatgatcttgatggttcttcgctttttctttttggaacttgcttatcaaaaagtaaatacaactgtttattcttttaataatccatccatacgattacatgaaaaattaggtttcatgaaagagggacaactaagaaagatcattttcactaaaggtgcctattatgatggtatttgctttggaatgacaagagaagaatttgaactgaatcatggataatatcacttgtgcatcgataaagtactggattccaataaaataatggttttatccataaagcaatagtattgcaaataccatttttatatggttataattagggtaatgatacaaataattatttattgcattttgatttgtggaaatgcataaaataaaaaagacctggggtgcgctaacacccactggtcattgtttgtacaaaaagccgcccatcagggcttgctcgatgttcaatctgcgtagacctaaccctttaaggttcctaagctcaagggaaggtctattttttcttttggcttgacgttacaatcatcattatattgaagatcaacaagacggtatttaatatcaatccgccaaaattgatcattatcattaatgattcgtaaacagtcattttcccaccccctttcataggggatgagcaagactcccttgagtgagcaaactttatgtacaggaaatattatactatacataaatgtccttgtcgttaaaaattcacaataaattgacaatatgaaaagaacttgctaaatgcaggttctttttttatttcaaatattaaacaattcccttcaaatgacgatatttaacatgtaaacttgtaccaaggaggatttaggaaatgaagaagagaattacatatgcactgctttctcttctagcagttgttgctttcgctttcactgattcatcaaaagcaaaagcggcagaagcattaccactctactatctacaaattacagggattacatcagacggaaacgattttgcttgggataatatcacttctagtcaaaccaaagcgccaaacgttttgaaggggaataaactatatgtgaaagctcgttttatgggttataccaagttaacagttatcacaggcaaagacggtaagaatctgttgtataacggcacagctaaaatgtttaaatctgatgctatccttggtcaaaataaggtggtaataggctgggataaatattttgagattcccatggacgcacttcaagataactctatacagattaaagcattgagctcaggcaccacttttgtttacagtcaaaaaattgattttgaaagagagtgaaccaggtgattagtacttctaattatgatgtaactaaagatccaaaattcttagctttttgtagcttagcaacagaagggtatggtcagaacaatactcagcaatcttccataggttttaacgagttttgcgaaaaacttgagaaaaatgagatcgttaaacccgagaataaaaaaagcacgcttgatttgaataagtctttagaagactggaaaatgagatttactgcaggcggaaacctttctacaatggattcgcaggtattagatgttatcaaaaaagcatataacttaggcatggttaataaagataatatgctgttacgaaatgaagcaattaatgcttatagaaattctatttaaataatgaaaacaatgcccagcttaataaaaatgctgggcgttttacttattggggttatttgcattcaaatactctcgatgttctttctccaatttattaatatcatcttttaatatatagatcttatatttttcctttgcttctctagacagattatcttttaaatactcacggagctttgcttcacttttggtttgatccatgccaattgtaattgcaggatctgtttgaccaatttgcacactgaatataccaaattcatcccgaatattatcaattacttccaaaggggactttttatttgcttcgattaaagtaatactcgacataatcaaagcaggaactaagaccaaaaatccgattagcctcttcttcattaaccattacactctccttcatggaaaagaatccctcctttattaatactacgcaaatcatcattgacctttatattttattaccaacatttacatcgaacttttgttctggtttatcttgaataaagaacgtttgttctgttaatattagatcaataaaggagtgggtcgatatgcttagggatcgaggaacaatcaaatggacatcaatgatgcttccagaacatttaacacaacttaaacaagatttgactgatgtatcaaaaattgaaaaaccatccttagatgaccaacaaattgaagagatggatcttctcgtctctgaggcacttgaatttaataaagagttgaaattcaaactctttaacaatggattcgttgaaaatgtcaacggcagagtccattacattaattttgaacaacacaggcttcatgtaaaagatcagcatgacaaaacagtatatatcaacatgaataacatcataggagttacatacaatgattgattactcacaatttccacgtaagaatatactttgtgtcgatatgaaatccttctatgcttctgtatcggctgtaacaatgggacttaatcctttaacatgttatcttgctgttgtaggaaatactgagagacagggaagtgtagtgttagctgcatctcctgcacttaaaaaagattttggaatcaaaacaggatcaagactatttgagatacctgaagatccaagaatacacattgtaaatccgcaaatgaagcttttcatcagagtttcgactgagattacaaagctgttctacagatttgttcctgaaaaatgtgtacataccctgagcgtcgatgaatcttttttagatgcaggaaatcaaaatcctgaagaaatggccaaagcaatacaaagaagtatgtggagagaatttggattgatgtgcacagtaggcattggagacaatatgttgctcagtaagtttgcacttgaccttgagagtaagaaggtaaagagtggcattgcgcgttggagatatgaagatgtgccaaataaactctggaaggttcacccgttgtctaaaatgtggggaataggagggaggatggaaagaaatctgaatcggatgggaatatcaactgtaggtcagttagccaaatttccattagagctacttgagaagaaatttggaataatggggaaccagttgtattatcatgcccatggaatcgatttatctgaaataggtgctccattgatgcaggggcagattagtttcggtaagagtcagattttactgagggattacacaaggagagaagagattaaggctgttcttctggagatttgtgaagaagtcgcaagaagggctcgtacacataataaagttggtcgaacgatcagcctgggaattgggtacagtaaggacgagcttggcggtggatttcatcgatccaaaacaattgatcttcccacaaatatcaccatggacatttatagatgctgcttgatgctctttaataagtattacttgggtaaaacagtgagaagtatttcagttacgttatcaaatattgaggatgatgttaaccagcagttgagtttatttgaagtggataatgaaaagagaaggaaactcgggtttgtcatggatgggattagaagcaaatatggatcaaaagcgattttgagagcagtttcttatacacctgcaggtacagcgcttcacagagctggacttactgggggacataaatcataaaaataaccccctcaatttggaggggggataagaaaaacatattaagaagtatgtcctctgcttgcaatttcatacgaatgaccatcagtaaaaccaatactggctgtatgtcctctgcgtgcttcttggacatctttttgagtgttagttaaataaatgcttacaaatccaattaaaacaatggctaaaataaagacagatgcatgcttaagtttcataaagacaatcccctctctgaatttgtttacgggcataaagcactttttcataataagcaacagccactttatggtcttctttttcattgtaatacttcgctgcatctgatgctaaatcctccacgtctgaaagcattgactttaattctaaataatttagaattgaatttaatttttcattgtcattatctacatataaggcatgaatgaattcaaacatttttgccataatctcatcgtttaaatttttggataaagacagaccgtgtgcacaccaagaaattccctcggagtgatttctcattttaaaagtggtttttgtcaacataagtaagatgtctaatatgcgatttgaatgttcatacccattatcctgatatactctaatgccctccttgaagtactcagatgccttttcataagcttcctcagcaaaggaacataagccgagattgtaaagagatgatccgattaatcgtgacatatcgatttctcttgctttatctagagcatctttaaaatgagggatcgctttttcagggtagtccatatccaaatagttcagtccgataacaaatgagcattgaataactcttacagtgtagttttcatgtgctttataactatcgattgcttgaacaatgtggtgcatcgacatatgtgtttgcttcatatgataataaatttctgcaactttatagtggaattctgctctttcaatttcatctgcaacaagtgataattttctctcggcttgcttatagaagcttatggcattaagatattcgtattgttcaaattcatacattccccggaaaaagttaaaataatattcaagaatccctttcaaatcagtttgactactttcgatcttttctaataagtctgaaattttaggtcgttcttcgttcaatgtttttggttcaaggtagtccagcatcagctgatggcgaaaacacatgagagaatagtacagcaataaatcttgatcttctttcatatgccttatttcttcctcgacctcagctttcaatatttccgaatctgggacactaaataatcttatgtatttataccactcatttattttcactccaactttagaagaagagatcatctgctccaacacaagccctcctatattaaatatctaaatatgtaatattttatcatatttaaatgaataaggaagattaatgttatcttaaataacgaaaaaaataccctcctcgattaagagaagggtaggggttttatctcggtgaatcataatccattgcttgttcactatcagaaataccttgagttgttgggtcaacaatgatacccattgcagttaaaaaagtcagtagagcattaaatttctctgttaaatcgtcaccaaatacagtcaagtcatatccaaaagcagaggcaattgcttgtacgaataacagcgttgcagagaaaattgcgacaagaaatgttttctttttcagtcttactttccagttgattttagtcattaaatcgtctcctgttaattttatttgaggccaaaatgtatgagtaaccatgcaccgataatagtggcaattacacttggtagcaccttgaatacaaggtcttttgtaaattgtgagggatcaattttacgagtagaatcagagcgttccaatatttcaactcgattatctagtttttcatatgatttgcttagattttttaaactgttgctcatttcgttaagagtactgaactgttctcttgattgtgcttgagagtctttattaatttcgacttgttgctcaacaagcgtagctatacgaccgataacatttgttctttcttcaagagagtcaatcttgttattggtatgttttgctttttcttctagtgcacttaatcttgaaatggtgctttgctcaaagttatccatttgtcaccaacctttaatgaatataggaaggtgactttacatcacctcctaaattaagaggatattcgctgatatgaatagagcagcgaatatcctccgagattattgaatataattaaatctttgaaccgaattgtcctgagatgtatccacgtttacctttgtagataacttcccagtaacccttagcattgtttgaccctttcactgatccagaaatgcttacagtatcgcccagatccacagtgccgagattcttcgctttgtttttatcaggtctgtccattacgatagcagcgctttttactccgacaactttaatcttgcctacagatttgattccactgctattaggcttagaagtggatttaggcttaggggctgattgtccaatctcagcatcacttttaatgtatttcacatttacatatccgctgtatgtagcacctttggagtttgtatatttgatataaccccaaccattttgagttgatcctttttggtattgaacagtggagcctttaggaagagtaagtacaatagaggagtttgcattgcgctgggttctcacattaagactgtctgcgataaccgtgttcttaacataagaaccatttgttttaacgacttttgttggtggctttgaagatgaggaagaagtatttccgccgagtgctttcaattcagcagcaatagcagatttaacagcattccaacgtccttcatcaagaactcgatgcggacagtatttgccagaccagtcttgatgttttttaactcgatccacgccccacccacgttctttaaggagttgtgcaataaatttaatagccaacgcttcagcttttctatagcgctctccgcctgatttagagtagcaaacttcaacaccgatagaagtccggtttcctgaattcacacctgatccatcacctgtatgccatgcattacgatttgtaggaatcccttgaacaacctctttatcatctacagcaaagtgaaaagaaacttcattattgttgccgatcatataacttacttcattttgcgctggtgcgtcgttgtatgtattgtgaaaagtgatgaatgaagcggataatgcataaggacatttgattgaatatttctctggggatactaacatttgtctcgctttaatagccatattaaacatctctcctaaaaattaaatttgagcacaaaaaagagagaaggggacaaatcccaatctctctttatctcacatatgctcttgttatctctgtttttcaagtatgtattttgaataaaatctatattttatctagaacgtaaccaccacctttattgttcctttattcttaatccaagttcaagctaggtatattacctacgttacccgacactcgtcttctgtctatatctgatggagttctaatgaaagctgttccttcaacatcactataaactgagtttccagttacaattaaatcgtttgttccagtgtcttcttgaataaagtaaaggtgataatcagagtggcattgcttgaaaacattatcagagaaaacagcttctcttacagatccccaaattgcgcgatcaatattattagtgataatgtttcctgaacaaattgcattttgagagtttttgtaccggacgaaggtttttaaggattttgcgaggttattcttagtgaagatatttgcagcattacccacccaaagggcagtaccgctaaatgtgatctcagagtcaattagtttaataatttctccttcagcaacgttaatgcactcgttggctatattggaaatatacattccttcaatcgttatagacttgccgatcccgtgaatactcactcctcgatctgtagcattaaccaagctgcagtctttcattttaaatgattttatatttccgcctgcgatcaatcggcagctactcttatttacactgctattgccatcaatttcaatgccttctatataattgtgatctgtgattcgcaacaattcatcaagtgagtgatttggatttcgaaggagtttagtgtaggatcgtctttcaccaacaattgagacatttgaagagagttcaattttttcactagcgctagttgtattctgtttaccgattaaatatgtacctttcggaaaatgtagtttccctccacctttttcagataaatcactaagggcttttttaaacttagctgtattatcgattaagccatctggtgagaagcctaaatctaatacattccaagtaggcttggattcaataaactctacacgtctgtttagacttgttgccaaacctcttccttcttgaacttcaaaaaatctgctatctgtatcgtcatcaggatatgaaattgttaaggtatcgaccactgcacgttcaatgccatcactaatgttattaatatattttccttcaacagcagtttgagagcttccaccaccatctaaaagaaatgcattaacacagccttcagataaaaataaagatggcatatcataagctgtaataccactggatcgaagtgagcggccatctacagtaataataactaatgtaccgtcagatctttgcccaatggcttgtcgaggatgcttaacatttaaatctgcccatgtagtcatttgagccgttcttggcttagaatctttaactagccaaataccaaaagcaaaagagtttcgtgcgcctttagaaattaggatgtcggcatcaacttctctgtttccgtaaaccttcatagttccatcatcaaaaaatacacaagcctcagcgcctgtgtatccagcagcgtcataatctttgtagagtactccgtctttaatttgaagccccatgacttcaccatttgatcgccaaccactagcatttattgcaaccacagatctttttcgtttggccatacttaaaactgtttcacgatttgttgtaccaaaataagaagatgtgggatcaatggatttttcaaagtcatatgcaaacgttttttgaaccatactttttttagcttcggttgttttaggagtaacctttgtaacatagtactcaataccgagagtagtatcctgtttaaaagagctcgttactgtaaagtacctgtcatcagttaataccttgtttaaaatttctgttgttttcgtttctacttcattaaacttctgagtaattttaggagcggtgtattcttctccttctgaagctagtagttcaacaggcatcggaacatatttatctaaattttgatcatatctataaaaaccagccataactttcctccaataaaaaagatcccaaaggggatcttagtcagttttgtaccatacttgtcctgaatctggtgctgtatctgaaacaacaactcgttttttctcaggtgaaaaagaggaatccttataccagatataatttgcattaaatggctctgttgcgcttagcagtatattgaaaccttcatatacttcggaagttccaatatctacccactcaaatccatcccaccgataaacgatttttgtttctttaacagtcaccgtccaaccaatctgtggggttgggtaataggtgaaaatatctgaataggtatagacagatggtttataaatttttcttgtattttctacaacttcttcataatttgatgtagcctgtctacaccaagctgtcacttcttggcaccgttttgtaactcgttcacattcagctatacgttcattcattcgaattattgtatcttcagcttcatcgataagtccttgaagagtttcaataaccatattcccttgtcgttttatccaaattcgagaggcagggaagaaggaggcgccttcaccactgtaattaaaggtaagtgattttccttcatttgaaacattaaaaaagacaacacccataaggtaatcaaccttaaaataattgtcttcaagctcaccatcttcaatttctcgccattccttgttacttcctataacttcgacacgaaactctctgtttggaatctcagtcagaagtactctgccgttatagacagttaatgtctcattataagtcagatagggatcatcaactgaaccttttctttttttacttaaaattggatcgttatacaattcagcaaagtcggtcagattaatcacctccgtttaattttgctggtaagcttcccatatatatttgacatttaatttgtttcctctaaaattttcatctgagccagttaaaaagattttatcgcctaaagctccgtagcttaaatctccgccaattagagagagaccagacgctgtacattgataggcataaccacctgtaggactttcaataaccagcatattgtcttcatttgaaattggagttattttgactagatctggagtaaaggagagggggatttgtttacttggagtaccgtctcctatataaacaccctttgcgaacttaggaggtagggggatattttcagctaatacataatctgatgctggtcgtccacctaacaactctgcattaccgtctattgaaccactaataattcctaattcattgcgcactggtattgaatttggcgaggtggttgtagaagctgtaaaaccatttaaggagtctgctgaacctgcagatgagacaatccattcttctccgttaaacagttcttgtttattgttctggggattgatccaaattgtccctgtctctggatcttctggcttagtttctgtggagattgtatagagaccattaacttttccactaaggcttccttttacttcgatagatggagaagggaggtaggggttttcagaaggatgatttgatttaactatatccgaaagaagaatctgatttatatctatatctgcatctactcttcgataagcttgaacaccgatagtgtagtacatatttgaaggtaatccggtaaaagtggctgtgcgtctgtcatatttaacattttgtaaattttcactggcttgcacagagccaaatgtgtattcctcattgtcatcactaccgtgtaagtaaacctcaaatccatcaatgttgtatttgtcctcatcggaatcaacatagttccactgaatggtaatatcaactgacccgttatcatttactttatgggtaattgcagtgccatcagaagcaatggtaggaggtgcaggctgcactgagattctgtcatttcggatattgaagttttcagttactttgtcccattcaatctttcttttatttaattcagtacttattttgtttgttctgtaaacggtcttaacgattttctcaaaatcagattgaactctttttccatttgttatagtgacactaatatttgattgttcgaaatcaattgttattgctgaaagtatggctttaatatcggtatttaaatcattctgttgaactcttactatgtctcctaaactgaacctatcccaattatgtttttcactaatacagttaaaaaagtttacaatatcgagtgttacattcactggcggtgtattacgactttcgagttcttcgttggcatcgtcataaagttcattctcatcatagatgctgtcatttgaccactcagttgtcgaaatgaaacgtgaaagcagtttttgctgattttcactaaaattgttctcaaaagaaagcttttctttaagcttagaaattgaagcagatatttgagaaattgttgattcaatcgtagtaatttggtttttcttttctgcaactgctttctgctttacggcaagttgagcttttagttgacttgtgtcatctccagctttcttcgcaacttcaattcgatctaataacttttggacttctagatcaagtgtgtaaagctcattattcaattcggttaaaccagtttcaacttcattcttttgggtgagaagtttattaaacgcatttccttcgctattaacaagatcattataatcaagaattgcatgacaaagttcatctggcatatagacactgtgggaaattacatttcgttgttcgtcacgttgaaaggggaagaggaaataagagaaatcatcaatgtacgattggccagtcgggttcactgaattaatacttatgccatcttttccagtagcatacagtcttgttaccaattcgtctgcatcatcagaatcgtccatgctaatcatatattgccgagggttcagtttgaggcctttgtatttcgaaatgtctgattctttataaaagcttatagtttcttttactgtatcaaagactggaactgcatcgaacttctcgcagattgaatataaaaaatcaagcttgttagttgatgatacatcaaactgtcttcgttttacgttaaagagagtatctatgtatccaaccgtccaactggtattctttaaacaatctgtaactacttcctggagatttttagatgtctcctcatatttaagaacgcttattctgctcaattcatgttgaagagatctacactcaacttgtacagtatccatttcactgctgaaagacttggttctttttgtgataataaaccaaatcgcaagcccataaaactcagttttaattaggtaccagggttttagtaaatctacaacatgattccttttaatgaccccatcataggtggccttaagcggaatagagaaggagagttcgtgaacgctgcttccatgatttaaagttacagttggattcagaacttcatcaatgttggctattttagtcttatctggcttagcaagggataagcgtatgttttttatctctgtatccttgcgaatagttatcaatttttcaccttcttaccgatacttaaatctgaaagtgagtctcagtttgcattttccagtcacttttaatcggttttttccgtaatccaatctaatataattgtcattgaaatcatcatatctttcattcccatataaagtcgactcgattatttctttatcaccattcactttaataatttctctgtcttttagattgctgaatataaagggatcagtataatcactcaggttctcgatttttacatcgccgtcgccaaatttaagaatttcaacagtagggtaaatcgcaacatcgcctttgttatggagttcaatggttttcattcctgatgatatatcaaaggaatgagtacttgtgtttcgactatatgcataaggggagttgcatttcattgtcaaacgaacatatccatgtctagccgcattatggactagatcactggtatctacgggcattgcataatacacaatgtctaaattttcactgaaagctaagggcttgtaatcatcaacatctagccagcgcttaattgctcttatttttttctcatcataattttcaccaacataaaagtttaaagcaaattgttttgcttctcttttgacaccttcagtgtacggctctgatcttccttttacataagtttcattaactgatcgtgaacccaaaaaagattcctcaactaacccagactctgtattaacgttttccactccgtagtcaatggacttttcgttgtcaaacaggaaatattggctctgtctaatcaatttttcacccccaatataaaaagagccggctttagccgactcatgttatgttgaaattcagtccagtatttttaagaccatttgctaattgtttgtacactaagcttgcagtttctttagcattactagcttctgttacattaattgtgaatgagttctgattgtttgatgtatttccttgaggtgtagaaggggttacagtaggtgccgagaagttcttaagagttggaattaagcctttagttagacttgtttgactagcaactgcagcgttcattgctggtgtaacaagagaaatactcttacttaaaacatctgaaattttaccaggttgaccccatttagaggtagtctttactgaattatcagtggacgtttgacgaacttgtttcacagcttccagcatgttttcagtatctgtcttgtttaaaataagttccttgtcatgtaagaatgcaagctttcctgctccaagtcccgtgcctgtatatccaccagaagcaaatgatgacacctttttacctgttgtattaccagttgtaacggtatttaatgcactggcagcgtccttaagcttatcaatcaagttattggaaatacttttcccaatcgacttcatattctcgtttatgaacttggtgaattcattaagctgtttagcgatatcagtgattttaccatccataagcttatcttcaagctttttgaatgctcgttcatcatttaccaggtcatcgtacttgttgttaattgattcctcatctttatcaagctgatcctggagggcttctttccgttttgtgttgctgcgatcttttatatactcatccaaagcttcctgttgttcttgaagttgtttctctaggtctttgacttgcgatttagcctcagaggagtcgtccatggaaagtttactgatcttatcttttgtttcctgtattgcttggtttttctccttcaattccttttgatatttagcttcttcgtcttctttgtcgatctcatcaatcttatcttgtgtcgctttctgatgggcttctaactcaatatcccgcattttttcgtacatctctttgtagatggatacaacttcatcagccaatgatttatagatgtccttgatcgacttcttggtgttataaagctcaaggttaaaatctttctgtttatctttccagttttcgatttcatcagtgatctgttcctggatgtcagggaaacctttcgcagctttcttttgctcttcaagctgtttgatatattttttggcttccttttgttgttgctgaatgagctttatctgcttgctatagtacttaaccttgtcctcatcttcttcagtcattgaaattttattatcaacatctttaattttcccttgggttttagaagatgacttttcaattgacttaagggtctcatcaactttagattggacaagttgcttctgtagctcacgaacctgatcttgaacagaaattaaatctagcttggcttgtttaagctcttcttgaagctgggcacgttgagcggagtttaatgctttatttgtttttatttctttttgaatccaattaactttttgttgttggattttagcttgttctgcaacagcttttttctgatcagaggtgtatttgcggaattccttgctgtcagaagtgtatcggttagccattgattcatctttagctatccgaacatcaaaatccccaattcttttatcaaactcatcgagtttggattgaactagttcatactgaagttcttgaatctgatcattgactgaatttatatctccttgaagggagagaagatcagatttagcctgggctatcccttgttgccgttctgcctcagcttgtgacgcatctgaaatagaagttccaatacctcgcatgtacttttcaggatcgattgtttttccattttgttcgatctgtaaatgaaggtggtttccagttgagttccctgtgctaccaactttaccaatagtttgaccggctttaactgattgacctgttttaacagaaggagtgttaagcatgtgcatgtacttggcaactgttccatcatcttgtttaataacaacccagttacctgcagttttactgtagccagcaatttggactttaccactttgaagagatttaattgctgtacctgcttttgcagcaaaatcagttcctttgtgtggggaggagcggagaccagattcctgttgtccatatttggagcttactctaaaagcgctattatttgtataatagctggcgattgaagaagtggcagatgagagcgatttgctatagttggacatgatcttcttgacgtaattctgtgtttctttaaaaggagggataccgccatatttaattacgttaccaggcccagcattatatgcagccaatgctttttcaacattaccgccaaacttttcaagttgttgggcgaggtactttgttccacccataacattttgataaggatcgtaagcgttatttactcctaagctttttgctgttgctggcatcagttgcattaatcccatggcacctacaccagaccgtgctttagcattaaaacctgattcttgctgaattacagctgcaataagggcagggtcaacattgtatttgctagctgctgaatttatgtagcttgaatacttgcctgaatatgatccaccagttgaggagggggttccaccagaagaagttgtagaggttacaataccgtattgagtaatgttaccggatttaatttgatctttaagtagcttagcttgttcctgcataagctttttcttttgctgaagtgctttaatttctttcttgattgcatctcgatatttctgagagtatttaggataatcattgacctgcttgttgtacttgtcaatctcagcattaactttttctaatgcttccttgtatttatcaacaacatacatggaagtcttggtttcttcattggctttttcttgttgatctgtccaattctccaatgatgttccagcttcaataagtgcctgtttattcatttcttgtgtactggtggcttcttcagatgcagaaatataagattctaaagctgatttaacgctttgcattgcttcaatttgactattggagtatccaccaggttgaagcattttctcttcaagctttttaagttctttttttgcatctgcaacattattaattgacttaacttctaggtctgacagttcggcctcagacatatcaagctttcgttcttttcgtagctttttcaggctgtcaatccgtaaggtatcagcgtttaaagttttgatagcgttgttaacttctgttttcatcaatttattgctgtagctaaccatgtcgttataagcatcaagtttaacttttctttgtttgataacttcatcacggttaattttcacaacgccattttcgatgctaatagccttggcaagttccttatctttttgaataagggtattagcttcatttgcagaaatacttttaccttcagccattttttccagaagatcattgagaggagctacttgatctttggtgttattaaaaatatccccatttaaggcatcttgaacggaatcgaactgcatagcatctgacatttctttaatagctgccttaatatcatcaacactatttgcatccagagcttcttttagcttcttaccaaaatcttctgcctcgttacctgcttctgccagcgtctcacctaaatcaccaacttcagatttgacggaagataagctcttatctccatcttttatgttcttctgtgctttgtagaagctcattttaaaaacatcaatagaagaatcggatttggagtatgtttctaagagactttgaagatctttttttgcgttatcgaaagctttttcatcgcctgaatctaaagctttttgcattttttcttgaagctttcctaaagaagaggagaatttttctaattcttcaggatctaaatcatcttttaagttaagtttgttgacaacatcactaatactcgtctttaaagtattagtgatatcaattgaactataagcatttgcaattgaaaggacgctatcttttactttagcatttccactctcaatgtcagattgagctttgagcatactttgtttagctttatcagctgcaaccttatagtcatcgtcatctgcaatgagatcccatttaggtctacctttatcgttgtagtcagctatttgtttgtactgctttaattcatccttagactttttaatttccttagaagcgtcttcgaatgttttctttgcgctgtctcttgtttcttgtttctttaaagccaaatactctttagtattctcaatcgctttttcaagctctttatttgtcttaagaattgcatttccttgagaatcatagcctttaactaatgcagggaaagtttgtgctaattgctgagtgacttgaaggtattcttgctcttcatctgaagttaaatatcttgactctttaactttttgaagctctttatattgctgtattagtttatcagtggagtctttattggtcgtaattgcttcgacattggtttgctggctctgctcaaaatcatctttagcttttttagcttctgcaaaagaagaaatcaatgattctagcgcccatcctaaagcagcaaatgcaccgccaactaatgttgaaacaagcaaccctcgaagagcagtttttagaactcttgaggcgactgctgcccgagtcataccagcttctagcccagcagtcgctaaagtttcttgccccattgcacgtgtgcccaaaattagggtgctggctaatgtgcgggtattcttactgagcaaaagggttgcagtgcttactgcagctaaaaggggaggtaggaacccaactgatttgattactcctgttgaagcgttaagcaaagaacctgcggcttgagtaaattcaattaatccgtcgctaataaaagcatctgaagccgcaatagcaaattcagtaaagttattttgaagcttatttatcctagcttgtagactatcagcatacttttgctgctcactccaagcacttcctgttgagttagcagcagttttagccgcattctgagcaatagagaagttgttcatcattgcattaaaacgggataactgataaatacctgctactccaattgaagtattttgcttttgagcatcagtaagcgtatcccacttaccagcaacttcactaattaaatcacttgccgatttagcttctccactagcagttttgacagaaataccgatttcatctaatgctttaattgagctttgattattcccaattcgtgcgaaaattgtctttagagagttaccgacgatattccctgattcacgtgttgtactagcaattgcggttgtgtaaccaataagatcatttaactcgactccgaatgtagaagcagttgaacctgctttacggatagaattcgctagatcgagggttgtaacagcatagttattatcaacctcatttaatttatctgcaattgatattgaatcatttgctgcaatattaaagttgagcattgctgccgtaagagtattaactgtatcatcgggtgttaaatcggagacattttgaagaacttgagcggtttttgttaacgtggtaagctcactctcgtcaaaacccattcttccaaaatcgcctgtcatttggagaatatctgcgaatttattcgaaagtgtattacctaagtcaatagattcttggagaagttcattatatttataatccggctcattcataacacggcgaatatttgtcatgagagtatcaatttctactgcctgggataccatttctttaaggctggagatagctccatagaataaagaaccggagattaaataggtggacatgcttttgaaggtttgggttagttctgctccaaaagaagaggcttggttagcagctgcttgagcactggaggctaattctctaaattgcatattcaagctttgaatttgtgatcttgtattactgcttccagcacttacgttaaggctatttactgcattcaaataatcttgaacagcttgtctattactagaccccatggaactgccataccgtgtattaaggttttggacatttacttgtgcctgtcgctgatataattcaatggttttctttaattcgttgttcttcgcaactgccgcagatttatcatctaacatccttatcctattttgcagtgcttcaatttgttgagcggattgagctgtgtttatttttcggccaagagatgagatggtcgtatcagtaacaataccttgctgtctaagcttctctagatcttgcttaagctgctcaattgctctcctttgttggtcataattagttgtagtttttgaagaagtcgaattagttttaggatcagttgtataaacaatatcatcgaacccgtggcgatttttctgcacaacctttgttggttgtccttgcagatttctctgctcggtctttttttgaacctgtcctagtttctcagtggcctgtgtaagcttgttaacttcttgagtttcttgctttaatgctgtattacgattgttgattatttttgtttcacgttgtagtatctcaccatttttcttatactgctgggtgagcttttcaactgatccgtcagcattcttaattactgttgaggtttctttaactgtttgattataggattttaggtttttttgatatgtatcgacagcagaggagaattcttgaagagcttttaaggttgtagaatcaatattagttttgagcttgagggaattgagtttcttttctagagatttaatttgctgatttaactgttcgacagttttggatgaggtatcagcttgcggggttagtataattttgaggttttgactcaagtaagaatcacttcctttcagtaggggagaggacaaagaaaaaagccactcagttattgagcgactttgtttgctttcttaataattacatccataacaccatgccaatattctgcattcttaagtgcttgttgaattacattgctatcttttttatacccctgagtattatacccttcaacttcttgtgtggggagaaaatcgatgtaatggataggtttactgaggtcttcaacagtaatttttagcgtgacagatttgaccatttcattttgtattgaagaggcagacaaccctccaattgcagctccaatgcctccagctaacaggccgccagctacgattcccgattttgatactttagaaattatttgattgcccaaagcaatttcggattcaataatattggaaaaagggattgtgtattcttcaatatgttcatctctattaagatgatatattttcacaagggattcagattctttaaaagcaattttagttttgtaagtattaaagaaattgtctggattaaaaccactgtcgaagtgcttaagtgtttccgcattttcttttagtttatctatatttttttggcttttaattttataaggctcaagtgctaatagggctaatcctgcaattattaagcaaattcccatacctctccagctatccattagcaaaaagaaaagacagaataaaaaatagccaccataagccataatcttataacccattcaaccaccgccggtatcattttcctacattataccactgtttccagtcatggagaactgtataaatggaaagtgaaatcattggtttttttctgattttatctgaatgagcagttctttgagataatctgcagttgtagcattttctttatcttttataatattacgaagtgtccataagcaagttatgattgtgattaatacgtaaattaatgcattcaatcggtttccctcagtaatttttgatagattcacaccaaataatacttgaaatcctataaacgatgttcccaaaatcaaacttccaatcccccaagttttagatggatcatattgcgattttattccttccatccttgcaatggcagatgataattcagacgggcttaaagattttattatttggactttccttgcatgtgtatgataatcttgtccattaatagggaattcatgcttgataaactttattaattctttgggattcatctcaaccagattgtgctttagtacttttttatttaacattttcatcacctctccatattatcgacgaatatgtaaaggattttaatggaaattagatttccaagggtacgtttctctaattctcaaaatgaatgaatagtcctttttaagatttatatacagtcaatctccaaggaaaaatgactcaatttttcgattttttatgtaaatcaaaaaagaatcatgttagagtaggtgtgctgaaaataatttaaaaaattattttgcgatatgattaaagtaatattgtcagagagttcagattggacaaaattgtaagtatttaatacactggggctgcaatcaaatatgcacctggaatcaattgctaaacgggggagtttaaatgaacaacaagaaaaatatctttgatattataatgtacattattttcggtgtgttaagtctttttttagttgcaaaaactgattatggcactggagttttagtgtttgttgcaattttatacctcgctgtaattgcttataaaattaagcaagtatttagtaattcagattcttaaggtgtaacacaaggaggattttaattgagaaagaaaagagttattacttgtgttatggctgcatcattgactttaggctcacttttacctgcaggttacgcttctgctaaggaggactctaagacaaccccttcttacgaagaactagctctacattacaaaatgaaaagtgaaaagatttcatcaaacgggaaattagttgaaattgagtatgtgagtggaaacgaaactcacaaagttcagatgaacggaaatgatcatactgtaaaagtcgatggcatagaacaaaaaggcttaaactttgagtatgatgaaaatgttgctaacagaacaaattatgaaaacaataatttgaaatctaatgaattcacaacacaggctgcaaaacctaaaaaaggataccattatgtggggactttatctgggcatacaaaagcagctaaaaatgcgttatcagttacaatgtcattagtcggtattgtccctggattgggatgggggagtaaggctgccacaattttattctcttattgggctaaagaacaaatccctgatgcgtattataaatatgatttatatgaaaaaggagcaatgactgatagctggtatcagtatgctacagttcaattttttgaagataaagcccataaaaagaaaatgggcaaaccttggactagtactcctgcaaaagtagatttacctaatagctaattttaaaatcactttgtctttatcgggggacaaagtgattctttgttttatacataagcaaaatccctcaaacgaggaatcttgattctgaataaaagagggattttatttggaaggagaggggggtattaagagaatattttattcttctcttcttcaaattccctgagatcatagtgagcaatggtagttgatacatcttcgtggtgtgcaacatattttgaaacgagctttaaatccactccactttcaagaagatatgttacacaagaggctttaaatatatgaggattaactcttcgttggagaatatcgcttaaaacatttgaacaaaaataatcagcccatgactttgaagcttgtttaacttcgccaccgtatttagttgaaaatatgtactctgattcataacctctattttcaacccataatcgcatgtattttaatgcttcaagattaatcatataaggctctactttcccatcatcaccttgaccttttagtcgcacattatgactgtatacaaatgtcttaccttcaggtattggataatcaagtatttctgttttgaattgtataatttcactccttctggctccaacattaaaggctgttgcaagccaggccatacctaaatagttctcgtccttttcaagtacatccatcatatctttgtactcattaaaagtaattttcactttgtcatatactttgtttttggggataggagggagtcctcgggttaaatttctaaaactccgatactctttgaaatcctcgtcatcagcaataacattctcgatgtagttaaacatggatgaaacacaagcttttttaaaactttgtgcagaagaggagagtttgcggttatcacgaagatagcttaaataacgaagaatatcccttttggtgagcttgtataaaggtttgttattcatcgattgatatacgtaataaccaaactgccttagtccagattgatattgtctttttgttgctggactaaagttttgaacagcaatgaactcatcaacaattgtccttaattcgtcatttacgtgttgccacatttcgtctgtgatttcaggcagttttttagccctatcccgaagcatgtttttcttaattttggtcattaattcaccaccattagtacgttttaattccatctgcttttaaatcactttttaatgcctctgttaatcgtccatcttttagagtctcggcagtattcttcataaaaggacgaggtttcccgtagccataaccgtatgaatctggatatgtatagccctgtccagtttcgatgactgttgcaacatcttttccttcgtcttctctggtattgtctaatgagataccgttactttcattaatagttgtaaaagcgccttttaggtttcctgtgcgttcatagagtagggggctataggcgccataaacatcctcttcaacatgagcttggccagttttcatcatgacttgcttaacattggaggaagacttatgtatagactgaattgcagctttctcaatcattactttaatttcttttatatttttcgccatcattgtgagacagcgctgccttcaatttcttcgaccttctgaaggataagattatttgcttcttcctgagatttttttgataactcatctatgttttgttgcagcattacagtggctttacccagcttttctaagctctctttaggaaagctattgataattaaaggaaagtactctgagtctacaagtttaagataccacttaactttatttttaatgtcatttggaatacccaaatctgtaaattccttgattagtgagaagaatgcccagtgaacttgatttatatccttgaaggatttgatacctgcttcttttgcttcttgtggatctgaaatcaatcctgttaacatttttgttaatcgagaaggggagaagtatggataaatgaatacatgaacgtcatcagttaatgtgactttttctttcttgtcatatttactgatgctttcctcaattaaacctaaattcaacttttttgatgccatttaatatcctcctttaatatcctcattttgagcaaaaccatgctcatctgtttattcagtagataaggtaactgaagtatagacttccccgacaatttctagatattgttcaggagtaattaagttattgtctactccttctttgagttcttccttagttacatcatcgtaataataggcttctttaacctgatcaagagttgcccagtttttgtttagggctataacccaaaaattgctcatgctgttgtcccatctttcaagtttttaacttcattttgtaaatttaagattaggcgattttgttttaagattaaaattctggcttcagctagtgattgtccaagtaattccacatcagaaggttcttcagggagtggtgagaggctgtctatgtattcttgagaggctgtttctatccaaacttgttttgataaatcaaatcgtggaaggtaataggagggagagtcaggtaatggaacagaagtgcaattatcgggaaaaatataatctcccttttcatccatttcagttacaactaggggttcaacgaacataaaattttcgtcatatttatagacttgtatcatgacttacctcctaattcaacggaacaactacatctatgtagtaaccagttattgcagcactgttgtcagctgataccccacttagctgaaggtcaccattagagtttacaaataatttacttctgccgaaagttccacttacttcaacagacttaacagcaccttgtgttggagaaaattcagttggaatagaagcaaatactacatctcggtttgttacaacgtgcccactaagctgtaaagtcccagctactttacgatattgaagtggcctagaaccagtctttgcgccatttttatatgtaacgcttaaccaaggcacgttatcaatttcactgctacttatcaatcgttcccaacttgaccatgctccgtttatcaatgattttctgtaagtcttattatcattagtcagaacaatagcttgaccataaagtttatcagcactacatgtccaaaatccccgcccgttacttggaggtgcttctaaggcagccttatcatatccgaaatatgttaaagtaggagaattcaaaagttcagaatgaaagtcgcttgttatagaaactagtggttgaccatcatcgcctgatattttagttaattgagcagaattccatttgcttctttcagtgctagtgatatgacgctcattatcttttatgtgagcatcaaattctaattttgtcgcttgtttatcattcgtaaggtttcctaacccgacctgaattgcagttactttatgaggattgtttgtgttctgagaatgtgcgtcagtatactttttagaattgctttccgcggcattccaagtagttctttcagaagctgtaatatgaataattgtatcttgagcatgttgatcaaattcagttttagttgcttgtttttcattcaggacatttgctaaaccaacttggcttttagttactgaatggggattgagagtatcgtttagatgttcgtcaaattcctctttagttgcttggacgttatttaaaacattgcccaagccaacttgctctttggtaactaaatgaggattagattgatcatcagtatgtttcttaagctcattctgttgatactccataaataaattcgttttttctgttaaggcttgttcatggtcaagcatatgtttttcagctctgtcattggatcctcttaatgaattgatctgaatattgttttgtttgagttgaccgacgtatttactgctgctcatcttaactcaccacaatccctttaacagttacatcaccagtaacagaaacaacttcgaacataactttaaacaatccagcaatgtcaaagtcccaatactcattagtatttaaagtactgcttccaagttggaaatctgttttattggtgccactaagtgcagttttttcgccattttcatcaactgcataaaactttatttctcgtgaagttgaggaaccggagatcttaacagtaagttcccgaaaatgaccaactacaaattcttcaccttcagatggggaagttgtggcttcgtgaaatgtaaatgaagttttgtctggaatcgtgattacgacattttcagtcgtttctgtcaacaactccacctccttaatttgaataaaaactgtcttttatctagaaaaacaagaggggaggacttattcaaaaagcccatcctcttgtagcttattccatataccttcccaagctggggtagaagaaggggatgactgaagcgaacttaaaggttcgtattcattgaagtcgccttcaaaccgttgcttgaaatcatcaacactgatataggatccatctgatagcaataggaatttttgttccaaaccatcaaattgtttgaacagaccacatacttcatcaaatgtcattattccatcccccatacaacgatttttaacccagttagatcaactgtaccggctgctttaactgtcagatgtatttttggagcagtgaaagttaattgtttttgtaaggggtaattctgaacaaaagcaatgctgttgaatagaacagaattatcattacctgatgtagttgcagaataaaatgggatgtttttcggtacggaataaatacttgctaaaactttgctatttgagctgtctgtttgagttgtgtacatagcaacaccgtaagttctgaaaacaccaagtgaatcgattagatcaactgtataagacttagttgcacctgtagctacggtatcagcatcagtaacaacaaattcagaataggatttttgaacttgggttttaattgctgcagtgtttttaaccaaaacagggacagaagccgtattagttatatttacatcaagtgcagtgttggccacattaacattaagaggctggtcattattgagaccaacctccaaggggacagtggaacgttcaattgatacagctgttatgggattacctgtcccatcatcttttgcagaggtgtatttatcaccgtcctggtttaaaaaagcaataataaacgcctccttaattattcagttgttccgccaagatctgaactttgagatgagccagttccttcatcactagtgacaacgccctttgtcccatcagctttacgtttcacacgagcaaagttaccgatttttccgttattatcagcaagggctcgatagccgatttccggagtgtatgcatttcctgcttcaaacgacatatctgcttcaccagagaagtttactttagggagctgaatataaaggtcactgtagatttttgaagtcttaggatcgtattcaattgtgtgaatttcaaagtagtaattctcagagaatttttcaccgttaatttcaacagtctcggcttcaacttcaatttgataatgaactgctaaagcttcacccttggttgcaaaggtatcgggcacagtaactgttttagatgcagcgtcaacttcaatttgatctccatcttcgttagttaatgaaactttagacaatgggagatatgaaagggtaactgtaccagtatcactaacatttagggtttcatcttcccacacagaaattgtttcgttttcaatttttacgccttgctgcattgccatgaaatcaagatcaaagaaagcatttcggacattacccgatacttctttacttgaattaataacatacaggtctcggttaccccatccgccttttaaaaagtcttgttgaacttgttgggaaaactgagtcatttgtgtaacacctgaagcaataaccttattatcgctcagacgtttagctgtaatttttccaacttcatggattactgtttgttttgccaaattgtttcctcctaaataaaaataaaaagagactaaagttaattagcctccaaataattgctcgatatttttagcatctttagtgctcaggtgataagactcttccttgtaaagattaatgtgactgctccaatcacttactttgacatcaggagagacggtagcaaaaagtgtggttgtgttataattcataacttcagccatcctgtagaacgacaaatatagctgatacatcgtcatttcagatatttcttcatacgtgtatccgttaaatgcagcaacacagcttactatatcctttaaatcactttgagaatcttgttgcttgagtgatttacttatatcatggaactcctgaagttcatcattgtcaacgaccttgtcttcagtgatacaatgcatgtctagtattagttttcggagacggggaaaattatgttttccaatcaacgatagggaatccttgtttatcaatacttttgaaaaaactttgaaataagcctcgtgaaaatcagggagtaccgaatgtacaatttcataaagatctctctttttcatttcaatgataaatgggtcaagcgagccatcctcattaaacctagagtattctttaatgagacttttcttattcatcctcaacatgcttagttctttggtgtagagaggataatcttttaagcggatgaaatcaatctcacctatttcagtctggatcggttttcctaagaaaaagaaatcctttaactcattcatttacttgctccaaaagtaaagatcatcttgtagcccaaatatccgtcagggggattactaataagcaaacgtttataatctactgttacaccaaaaccagcaatatttttattgaaaaatatttttgaaaccctgtcgatgattttcaaacttcgatactcagatatctcaaatgtattaatgtgtgtgtatacatcgatcatcaattcttgatttaacaacataaagctttggtttgtcggcttaggcaatgcattacctaaataaatacacatcctacataatggtgaatccgatagatcatctgttttaggtgctcgcttgaatatggtattgattatagggggagagtcatttgtggagtcataataattttcgagtgattgaacatctggatgagaaggggagagaggatcagttttgtaatacaagagccgattcagttcaacatcatccataactaatctgaagacttttgtcatctgttcaacagtcatgctcatgtcttttcaccaactttctttttggcaaccaattttattgttccgtggtctccataaactttagaatagtctatatcatcgacttgataatcttcgccaaagaaggtgagggtaagtccaattttcaatttttcatgaacaagataaggaattgtaatgtttgcttgaccatcaggaagatttaccgccaattcagtgccatttattgaagttgtcctttcgaatatgcaggggacttcagttttttcgccaggtactttttcataaattggcttaccagtgatttcgttaattttgccagtatcgattagcttgtcttctgaagtaagaaaaaatgatgttccacatatttttatctcagccttcttgtaaatcttattactgagagggtgggaggtgatgagccatgtttcatcattaaacttaacaactccgccacgataaatgtcagcaatttcacctaatatatatcttgcagaaccatcgccactagagtacttagaggtgatcattactgttttttcgattccatcaattgtgactttttcagattcaaaccccttaaggccttgctggaaaataagcttaccatcatgaagaagtttattattaatgttaaccttgtggtaattactgtagtccttcattcgaatcaccgtctgttactaagttatccctaagtctgcttaattcaccacttactgttaaaatagtgtccctgatttctgtgagttcaggatcacttagcagctttttattaaggtatttctccaatttgaagaggactgaattgtttcttttacacagtttattgcaaacaacatctaagtcctcaagctttatttgtccatctttatgtgccgatttaactttaattgtactcatagataatccaccgcagcgttcaatatcaagcgctcaatttcgtctttctgatccattacactttgtttaagtgaattgagttgcgtaccaaagttcttgatccccacgtcattcgtgaagggctgccacgtattctcaaacaaggtctttttatttaacaaaaagatgtatctcaagaagtgtgcaagaataagaagatcatcctcagataattctcgattaacagtttcagttgaattatcagcttttaaattgtctctaagccggttattgaaatgcaggattgcatttcgaattgatttataaatgtcctcttcttgttgaggaacatcaaaatcggacgtctcgcagttgtttaaaaaggtttcccatatttgatcataagatgtcataaaaatccctcctcttagtcaaagagaagggaaggatcagcgactcccatccaatcagccaaaacttttaatttgcctgcagcaatgtcatcactaaattctgaagcaacgtcaataataaattgcttctcagaatccactgtgattttatcgagcttattttttagttgagcaatatttcccgatttaatcatcttttcaatttcttctttggtatgaatgttattttcataagcctccgactcaacaatagaatctttaatctctttggttgtctcgttatcttcaacaataactaattcacctttatcgaaacaaacgctgttcattgtgagccattcaacaacttcttttggaacttctttaatatcagccttaccatttttactaccagcccaagtatattgtttatgtccaccatcgccggtatacccaacaaaataagatgtacttctgtatcgtgctaacttaattttttcagtcaaatttatatcctcctaaaaaatcctcatattttgatttagatagatactgcagcttgttcttcaataattccgattgcttctccaaaaagaaggttaacagaagcatcttgaacaattttcattttgattctttcatcttcgatatcttgttctgtcaattgacgcagtccgccatactcaacaacagaaaatggtttttgagaaacgccgccggcaaacatataacctttgttgacaggaagttcgactttactatttgtatcatctgtaaatgggttagtaaggttaacagcagttgttctgccgattgtagttggatttagggcagtgaggagttctcctttaacttcttctgttaagaagttcttaaacgtggagtctgttccttgttggaatgcaaagtagtcgataagaagggtgtcagctacgaagataggttttccaccataacgttgaagaacagaagctactttgttgtattgttgaagagtaaggtttgagcctgtttggacattttttgcagggattttaccagctgtaattgcgcttgcagttagttgatgaattttatcgaggtacaagcggactttagcatctgcaatatcattcaccaatttattgaagtaaacaattgaatctgttacgagatctaggggttcataatagaaacccgttgacatagttttcggaacagctggaactgtttcttgtccttcaacacgaactaaatctacaccagagccagtagcagaccaaatgacttttgccttattcttttttggaattttaatttctttaatattgcctcgtttttcttgttggacattggccagaagggagagaagctgtgttacttttggtttcgcaatttcatcagcttgttcaacgacaaggttattaaattgatggagcatggaagggtcaggtgtagtaccgccatcaccaaacactttcttaatgtaagtttggatatcagcttggtctgtaccgtccattttgttatttaatacacggctaaacaagcctttgattttcacagtatctaatttcatttataatactccttttattgaaatttatttgttatgtattaggcctcgattacttcaaggcgaacaagtttttgtcccattgtgtaaacaaggtcatcttcattatttacaacgaggaacttagcagaagaatcagcataatcctcatgaggggaagcaggatcactaagaatatacttttgagtagcaatatcaaagtgagctacttgaccttgtttaacctcagtcactcctgtattaaatgaaaatgcagaaacatcaaaacgggtataagctggctcaaggataacaattcgagcatgttctcctacaccgttataaaaatctctcattgattcaccaagatagcgtgcttcaggagatgcaattaaatatgatttttttgttttatctgataacttcgaagctgtacggtttccctcagcatcaaatccaagttcaacaagcataaagttatcaatatctgatccagttacttttgcaccgtgagcaactgttttaatttttaaagaattcaagtttccagtagtatgattccctacttcagtaagggctttttgtaatcttgtagccatattttattcctccgattttaaaatttattgtgaaaagcgggattcgaaagagtcatcattagggattaaattttcccgtttgctagaaaattctctaatggttgtattagtttcagcagtaacactaactaaatcaactaacattgtgttaagttgtaatacagctttttctccttcttcaccttgtttaatggaagcatggataaggttttgtacttcttctgtactgaatttttcctcagcatttaaagcttcaaatttcgctttatagaattcatttttctcacttagtttttgctctaataaagttttctcgtgtttttctttataaggcttcaattgttccacttcagaatttaattgcacaagcttttcactggcagtgttgaattgctgttcaattcctaccttatccttattgatttgatttacttgtttcgttaaatctttaatttgttcatctttctggttaagctgtgattgaataggttcaggaacaacttcctcccagttgcgcgtcatgaatacctcagttttactgtcaaaatcaattgaaacagtatcgcctgttcttgtgtaattgaacttaaagtatttgtcaaagctattttcatctgaccagctatacacgtttacgatgaaatacgtatcatatacatctgcaataaatgaatctgattctttatcaagggttggatctaattggctatatagaagcgtccgaacgtcagagtgagacaattcaaacacttttctaaacttattcattttttcaccttcctcattattttgtcttgtagctgcttgagccactaatctttcaaatcgttgaagttcattaaagcttagaagtttggaagaatcataggcggggaggacaatgtcatgctctccacgtttctctgaatttaaaattgcatgaccttcgaaatagatgggggactgtaggtgttcgataccatcttgcacagtgtaatttgaataaaggatctcacaacttgtattaatgttgatgcctctaccataccattcaagtaaaagttcacatgcatctttaaatcgagagctccaaagtattgcatctgctgccaatacttcttttttaccatctggggtttcaatttcagttatgtatccctcggatgtaaagacaccgattggggcagtatctctttttacttcaagttctccgtgcttgtctgtgtctagataagcttcatgagttcccaatgcatctgtagaagtatttaattcatcaacctcgtaatattttgcaacaatcggtttattaataattgttgaagcagcttcaagagcaacatccttagaaattactgcattattgtgagagacatcgaaatcaaaaatgacaaagctacatgacaactttgttgggtcatctgatgttttaatctcattcaattgaagttggcatagttttttcttttgcttctttgtcaaataatttcacctcccttcaaaagtgaagttttatataggattgtcattaccgttggatgtagctgacttcactgtgttgtcgttgtctttatttccttcatttgggcggcctgcttcattcccagtgaaggtatatgaagtttgataaggtctaattttttcttggagtttcagctcttcagtttcatatagagtttgttcaaggtaactttcccaagacactcctgccaaattatcaactacgtgcttaatagaccaacctttatcgtttagcttaattaagatgtccattttttctttaagagtgagcggcttgtctttatcgtaattcatatagtaattgtctttttgggcagcaggcaaaacaaggttgaataacttttgataaacctcttgttcaatatcctccattaaaactccaatacgcttataaaatgtatccaagtttaacgacgaagttgcgtagttacccccatcaccatttaaaagggagccggataagccgtaagcagattgaatgtcgctattgatatggtcaaattttgctccatctaatccatctgctttaacatcaggaaagttgatatcagcaaagtcagggattgatactacagttactccatctttctgatttttttccaaagcagttttaacgccaccatgaattttttgtttaactgctttaggcagcttcatgtttgtgtattcgccattacctttatctgttccaatcgttagaactgcaacagcgttaataattttatttgcgatggatctttcaacatctttaagcttctttttatggagaacgtcatatagacctggggtaacccaagatgttcccaatccttgatttctttttagcgtccctgtgcgtagtggaaaagttctttcttgtggcaattccttaaatcgatatttctctcgatcttttatgaagttttcataatcgctttgtttaatataaggggagaggctttttaacaattcatttctgtgatcatctttatacttagtgaacagctccatgtcaactacacatacccagtctccatttcttctaaaggaggggaatacatatttaatctcatcaaaaataaacggataggggctcttagcatccccaagccatataccaacaagagtaccagctgtagctacctgttttaacagatctctagtaagtcttttgtgtttaaccttatgtaaggatttattcaaaagggaagtatgcttatctgaagacttaactttattaaaggagtcaattttatagttgagggtagggagggcttcaatcaattcaaacaattggtgaatctctgcagtcgaaatgtaaaaatactcagcaagatcttcaatttcttcttgaaattcatcggggttagaaaaataattctttaattgttcggcctcaatttccgtaacaatgccattggaaaacatgtttgatataaagccggaagcaaatgtagaagtataagttgaatagtcattcagcatttgcttatactcttcagactcaatgtcaactttatttaaggttaccatgtttcacctcatttcttttaaaaatagactagttcatcttcaacgtcatattcagtttgtttgtttaactgtctttctaatacagtagcaatatagttgccataagccactgagctatatctgtcttttcgtttactctttggctctttaagcttaacttgtccgttatcgctatattcagcttccaagttgatcatttcatttattaaaagggtaatctgagcatagcttgaaaggaatttccctttaacttcaggagatagcccttcatagcctttaaatcttttcagatattcttttccttcattttcgttgataggaattttgatttttcctcgtttgaatccatctttgagtaatacagcaatttcgctgtttaattgtgcattacctttaatgctataaattactttttcggcattttgataagtacaacgctcagccattctttcatcgttaatacatgaaaatggctcatattcttttgcgcgttctttatcatataaaggctggcataatgcatcatacacaccaagtccgatactttgagtatctaatacaatataatcgcaatcataatcttcgtatatttgtcgaattcttgttgcttgagttcctgtgtgaccgcctacgatgctctccatgtatacaatatgacgatcatatccattggagtttggaatcagtctgaatacagtgtaaacactggcatcattatccttaccggccattccagcgatatcattgcttaccagtctaatttctcctggtttcttgccttcatatttgaagttggaatccttgattagactgtaatagtcaggagggaagaggggagaagcaagtttgcggttcttttcaatgtcttcaaatttaaaataggctttttcagattcaccaaaccagagagcttccatttccatagaccaaccgataggatcaaagtcttcttcggccatttcatctctaacctgatccttatccaaaaggccttctttaattgcgatctgataagggagaccgcacacaaaatattttgatcctttcatcatggcattgtagtaagttatgaatctgttaaatgaccaatgaaccttgtaccagcaggaagacaagtaaatttctttgtttcgttcttttaagtgtgcgtattcttctttttcgagatatttaggagaacggggagctgtcaggaattttcgaagtactttactgatgatttcaaaatcaaccattctgaattcatctacaataaggaggtttgcacgcttggagcgggcgccatcatttgaggctacgattttaatccagctgccattatgaaactccactttagcatcatttgttgaggtttttaaatcttcaatttctcgccttaaattaggtgattctttgcgtaagtcatcaattttctctatgacttcacgagcttgtccctttgtgcccgatgcgataactattttagtacctgggaagagtatggcttgcacacagcagtatacagaggttaaccaagttttaccttgtccacgactggccaagtacataaaataatggttatgtaccatcatgtaaattaaaatacattgaaacaatttaagtgtaatacccaagtattcttttacaaagcgatgtgggtttgctctatagaaagaagtccatgcgccgataccatccattaatcgttcagattttgatttctttttaaagttgtttccctttttaaagatattgattcctcggctgtgcttgttgcgatctgttgtaaaatttttatgtgaggtcattttctcgatcctcttcttctgcaacaggttcttcaacagtatgcttattcatttcttcccaatattcctctgaatattgattttttaaaccaagcattcgggacagatgcccaaggaaaaataccttaatgtatttcccgattttatcaggatctttccacctaggctctggctcaggaataggtctctcattctcatattttttgatcagagtgccaaaagactcttgttcaactccacttgctccagtttcttgaactggttttaaattacttgatccaagtaaatcttgaagagttttttgctgctgatcgactttttcaccattttcacgccgtttacggatatctagccgagtcaaacatatttcatttataagaagttccattcctttagaatcacattcatacctatttgtgaagtcaatgtactcattctgaagccaaatgtaatcttcaacatcaagaccacgaccccagaattgcattaattcatctatgtcttccttagatatatcttctgtacttttagctagtaacaattgtgttgtgtattcttgttcttcttcaaagtcaaactcactgtctgcccaagtttttgacttgtaatctttcattccgatatttttcatatacgtacccaacacatttccagctgattttttcttggactctgattcattaacagcggaaacccacaagtcgtaaacaaaaggacggtcaatcattcttaagatgttttgaacattctttaagctatctttgtctttttggaattcattttggagacagctcttacatactgacagcttgccggttgcagaattgaaaggagattccgagatataatattgattggcattttgctctttgccgcagcatgagcattttattttttctgcagacatatttcacctccataaatttgatgtaaacacattttataaaacgcccagtaatagagcggaaggggagtaccgcaatcatcgctgggcgttctaaaaaggtgcttaaactaaagaagagaggatttcatcgtgatgaaaccctcctttgatctcaattcctaattttttaattgttttgagttgctctatattaacagtacagtcaatatagacgccattcggaaaatgattaccatctaaataattggctgagaaaatagtacaactaattcctttttctttagccaagtctttataaatctctttatgtccacctacaagtaaagggatattgttctcttgtgataacctaagaagaagagttgttttgcctttacctctctgagaatcatttaccagaagaaccttaggtgcatttttatggaatttttcttgtagtgatttatcaacgtcattaaaaacaactttcattcgcttgaatggcggttcgattttatcactaaaaatagttaaatgaatggcttctaatactcgcttaatctcagcatcacatctgtatccagatttttttaactctgagagagtttctaaatgtttatttaagtatttaaaatcttcatttgtcattttcgtcttcatcctcaatcgtttttttgtttttgtattactttaataaaccttcaatagctcctaggctcacaactgtctcattaggtgaatagtgttttgctgccacactcatgtttcttaaatcatctagggcaattcttttatttataaatgcttctctatgagactcaataacatattcaggatcaacaaatggcttacttacagtattacaagtcacttcttcataaacagcaggaatagaatccagtagatacttataatcacatagctctttcattagttgatctttgttaatgtttcctgtttcatcttcaatgatttgcttccagaaagactcgtaaacctctttgtaatcagccacttgcactactccaatcagaataaaattaaagttttatatcaattaacaattaaatttactaaagtgttcttgctttcaggggacaggttgtcccactgttctgctaatattcctataaattcattggcagacatagactcatccctttatttttcatttttaaagcgaataatgtatgtagcttcaacaccctcatcattaaataccataaacttttgagacggtttcgtaccaaagcgaccctgcatagcataatcatcagcgccaacaagcgctccgtttacaacaactgttgtgctgccatattctttttcatagttgtgatgaatatgaccaccaaatatgtaagaagggatatagccaagtaattgaggtaggcgggttacgcattgatcaacacgatcatagtgaccgtggacaaacacgactttatgattgttgattttagcggggataaaaccatcttgttccggttcaattgaaatgtttttaatatctcttaatctagcttcaaggtaccaattaatgaggtattcaaagttttctttaatcccgacatcattcttagaaggggagagacggccgtgattgcctgctacgttgtagaacttaacttcttgaaactcacttgccaacatcgctaaaacctcagcaagcgtttctgatacatatttaatttgttctacagcatcttcattagcctgaactcttgttgaaacatgtataagacctccaattaaatcgccaagatttgcaacgtgtaatgtggagacatgattcttctttccatactcaattactttgtttgtgagatgctcaactcgttcatcgaatatttttttattgaacttattgatgcggttatcgatttccattccgaagtgccagtcactgaataaagcaagcccatgcttttcagcagctgcagggagggggtaagtgaaacgaagaggtcttttggattctaaattaacaatagcttggactacgtcatccttgattttctcgaagcgagcttgattcgctatactttttctgtattctcttttttgatcacgagttctaatcttttccttttcagattgaagtcgcacttcttcgtatttccttagaatttcttcatccaaattcttggacattatgtaatcattccatcgttcatattgcttataatccttgcgccatttactctcatcataatttgtaccttgatctttgtttaagagagcggcaatggttttagtatcaatgtgataagtatctttatttttaaaaagtcggatgtggtagtcggtaaaggattcttccttttcacggtgcaacacagggtttaaaatagctgtcatttagtcaccgcctactcagagagtccttcagtttcttgaggcacaacttcactgtcgctttttaaagtgaaatcaatcggttctgttttgctttcaatttctcttaagtacttagataatgagtggatatgtatcccatcatttttatactcaataatttgatcttcatcaatgttcacagtgcattttttaaaagaatattctttcttacctttagccaagacgattcctccaattatttgttttatttacgaacaataagctccttcggaagcccgatgatccgaagcatcggtaacgtccgaaaaggggatataaaggagatgaaaagataagtcggataggcgatggggaaacgcccgaaggagattattgattacttgcgtaccggaaggctcggaagcacattccggctgatcagtaacgtgaaacgcaagcacaaaaagaccttctaacgatttagatggccttgttctgattacattctaaccctgtttcacctacattagtagttcacgtagggacgcaagccttcagatcgacagggaatacgctgattacgggttcagcgactgaaacctttgtagtcgacaaactataagtaaggcgaaaataacaaaagacgccaaataacgtcttcagaacctccttgtacatcatggtacatgagcataaaaggctggttatcgctgtgcgaaatccagctggctccttctacacctggcagatgagctatgacaacaaataatacacactttatgggacgtgtttaaagtccctattacctttacatcttatatatcaagtttttatgttgcttgccaacgtccggctctcgtagtccggaaaatgtatcaagtttttatgttgcttgccaactgctcagcccttagagtctgagagccaaggaaaaaataatttgagaagtaaagacccattataagccttctcaatggcattttcagtctctcttgtcaggttacacgccttattgagaaacaaagcgtctcaaacgctcgccatttattttgcacagttttctctgacccgtgtaaggaggtatgtgcatgggaaaggtaagtctccattcagaaaatttaaggagaagtagcgaataaatagtgaatatgttcctaagtgaaaatgaaaaggcaagaccgaaaataatccttttctgtgaaatgagagcggtgatcaagcgcccaaaaccatatcacttattttacgagggtatgtaatttcaaagcctcgtttacccggaaaaattttgttgaccgcataataagcatcaaagcttacaagggcattatttaaagggaagggagacgcatctaccttccctaagtgtaagccgaagcagtacaccgcaattaatattcagggctacatgtcgcccatagtaagactgtgatgggtttcaccctacataaaaaacttccgtagcaaaggtcttaccgacatgtttagcccgataatagtcatttacctgtctccttaagatacaggcatccgagctatcctcgaaccctcataaatgaccattatccgactaaccacaatgactagttgtagctgtaaagtcgaatttaatgcttttttcgtatgaaagtgagaatagacatgtttagaaaaagtttcatccacgatggggcaataccccgctaatatccacttatccgtaactttggaattccaagccctcaaacaaatgaatattagccgagaactgatatcccacatatcagtaatcagcttattattgacgacatccccatcttatcaataaaagaactctaattaataaacctgaagatgaaatgcgggagaggatttgcacctctcatggatgacaattcgccaactattagtcttctcttgaaggtcggcctcgagattcccgaaggtcagtcataccacctcgatctacgcgtttacctttttcgccaccgcattctagggaaaagggaggaagatattacattaagctttcactgcgtcttttagagcttttgcagctttgaaggcaggtgcctttgtagcaggaatatcaatttcctcgcctgattgcggatttctccctttacgtgctgcacgttcgcggacttcaaatgtaccaactccaggaatcttgattgattcaccttttgctagtgtttcaacaataacatcaaatactgcctctacttttggcgtagcttctttcttagtaactcctaatttttctgcaactgctccaacaaattctgttttgttcatgtattaattcctcctagtgattttgtttatttttgtgttaaagtataattacggtaacgtttgtgattttttgaaaaaacgggagacttactcacccttatatgtggaaattagctttctttctcccttatgacgattatctcaaaaggggcttccagaccagtcgcatcaagggtttaaggcactttttttgttgaacttttttcggtaaaatcgctgtaccccttgggggagtaaggctgaagggactttctatttttcttctttcctccatttatcccttttccacttgtttttttgcttttgtgctattttctttgcacaggttggacaatatttcgccttgttcgatgctgatttgaacatcttaccgcaactacagcatcctctataagtctttaagttatgtcttagattctctaatagagtctggccaaagcactcccataatgttgatttaaatttgcttttctttttatataaatgcttaaccaaaacatcagaaacatattgctcgtcgttgtgaaccttcatcaatctgtcttttataaccttataaacataaagtttttgtccaggcttaatgtcttcatcattcatcagccatttcttgttctggtctaatcgtttgtattcactaataattgcatcgtccactttaatctccttgttcttaagcaggaaacgataatcgaactttcctgcaacagctgcgaaattaattcggtcagaagggataatggagtctaacttatttactgtgctttcattaattaactcaacgctatgttcttctttatcctttgcattgatgaagaagtggggcactttattttttatgtaatctttgattttctcatcaacatgatcaggacgggtgggcatgaataaggtttttgcaaaatcgatagtaaagttattctccatgcatagccatttgatcacgtccagatttatattgtcactgttccatatcttagtgatattgttactgtactccccgatattgatcccataagcaagaattagtgcttcatagatgtttctgctattaatctcttgtttctgggctacagacatttcataatacaacggaacgatgttttccatattccgcttggcaatattgacgattaactcatcagaaataattaaggccttatccccgtcattgtcaaactgcagcagcttggatatcggatcatgaatgctggtaaaaacacctggggtaatgaaccacttttcatattcttcgtctttcttgttccatctaactccatgttctctgtataggtgaggggagcggaggatatcaatatgcccttcatcatataaagaacaataaacattgttgccggtgagaagtccttttggattctcaatcccaagaaacagcctttcacaaaaagcatatagatctgggcataaatacgtatacctagcatcactaacaagtaattttcctgatttggcgtccttaatcatactcctcttcttattcttaatgatttctttggtgtgatcatcatttagcagctcaggatatattagtagagcttcttgaaggcttgtcttatgtttatttttctcggtagctcctaaaactttcatcatggtttctttatcagtgcctaattgagtaatctcactaacagtctttaagctgatttgtttcaattcctcatctgtgatatcagtgagtgtttgaagcatctggtaagtcagtttgccctcaacagatggatcttcttcatttaattttgcccctaaacatgcatactttttaaatttagagcgataatcatcccaagaatcatagtacttccacatcttaaactggcttttcgtaaaaattatttggatatcatctttaataatgtcccattctttaccgtagacgtccttaactgtaaatgaattgtttttttcagcaaactttctaaaatcaaatggaactagcagacccttaacccaaggtaatctgaccataaagcttttctggctcaaactgggaagcatcattccacaaccatctgtatgttctataggaatatccataatcttacgagtgatttcatatgtatcacggtcaatataatcaaccaggctggaaacgtttgtttctaagtcatttacgacaattgctttatcaatatcaatttcccatgaactgctggcgctattcgataaggccatgtagctattccatttgtttatgctactcccaccttgagtattgatttgctccacactaaggccacaagttaaagcattttgatacttatctaaggtgctttgcttgataaaacaagactttttggttcgtatttgaccggcactgctagtgaaataaacgtatttctcattgttatgtatgaatcctttatcaataatgtcccttaaaatttgaaagtgataagtttggacaaccatgatctcttcagagagagagttttctttgattcccaatgttcgagttaagactgaatcaaataatgaaatcacattattatctttcagggaatctgttctaagtgttcttatttgattatgattgttaaaggcgttataaagattttcttttaaggaaataatcctttgcgttatgtacttcttatgttttttatcaacatgttcaagttttttgagatgatctctgtacctatatgattttaaaatcttgttatgtaatttgttttcttgatcattataaaaagcagaagtatcaatactgtaaatatgtacttgcttatttagaccgtctttttttcctttcaataaattctccccttgtaaattaataaactattttatttttattcttaataactgctatttaaatattgggacactaaatttctgtatgtatgacttctttgattaactgttccgtaccacaaatagtcttgataaagattttcttcttccagtgtagctgtttcactaataactttagcctcaagaaaaccaattaagttgctaaacatatactgtcttttcatccaatcacctccatagtaaatttatttttatcctaaaaggagctaataaaaattcctgtgtataccaggtgattcgattatatattttatttttattcttgtaaatataaaattcaaaaaatattaaatggatatatgatgaaaagtggaaatagacacaagaaaacctggtgtagggtcatgttttatatttgggaataagtttgcatatcgtaaagttatcgtacacgaaaaacatgcttatcgtaaaaatttataaaggactaaaaaagacagtaaacataatgatatttgatactttaatgagtaaataggggcaaacgatcgtaaaacataagcgggagtaagggaaagaagttgttttaaggagatattaatgaaaaaggagaaatttgaagagaaaaaaacattgataataaaggtttttacgataacgattacgatgtgaaaaaggacgatttaatgtgaaattgggaaaatgtaaatttggaaagggtgtggaaatggaagtgctatgggcacattagttctcttgtttttaccattagatgtaaatatacccccatatactggcagtgaaaaccccatataatataccttatgtagggaattctttaatcctgtttattcaacacagctataacataattccaggccaaacacaagaataaatttaaaaaaataaattggtcggcaatataaaaaatgaataacagttcattaaagataatcgtatttataacgaatccgaggggatcgaagacatatttattttatccccatcactatacataaccataccttatataatcatatatccttcgcatattactcaacacacacgctctcagaataaaacacctatctaatccatcctatattcatcccaatatcatttgctatcccaacatctaaataagcacacagacgaatccaaccatcatcacattcaccaacaaaatataattatttagagtaaaaataaaatgactttataggttaactatgttataatagagtcataggaaaggaggtgtacatagtgcttgagaaagtgggtatcatagttgctttcctcatatctttaacggttcttacaatcaacagtctaacaatagttgagaagataagaaacctaaagaatgggacaagcaaaaagaaaaagcgtatacgcaagcgactccgtagcaagagacaacgcaaacgtatacgcagatgagtaccaagctaaaggggaatgaacttctcctttagttctacccatattataacatgatcaagcacattgtaaacatgaaacgattctctttatggtttacccatatcacattcattggcttattcttaatgtttcaactcattaaggattacttcagcagcgaagcacaaacactaatcaacacaatatatgtagtcacatgtatcattgccatactgttatggatcatctattttgtattccttaaactaagaaacaagtcacactaatcatataggcctcatggtataattaaatcattgaggtgagatgagtggagaaaaaattcctggatgctattcggcagcttgctaaggaattagaaatgctcaagaaagatattgactccatcaagaaaacaactgacagaattgattcagaccttttagagtacagagaagagataagcaaagttaaacaacatgaaccttgaacacaccagttaaatatcaaactgtaaataaggagcggtaaacatttatcgttcctttattttaattaaatcaaaaggagatgctaagtgaataaagttaaagtagttgattccataatgggatctggtaagacatcagcagctattaactacatgaacaacgctaacccagaagataactttatatttgtcacaccttatcttaatgaggttgagcggataaagaaaagtgtaaccaacagacaaatgtatgaacctaaagtaagaacaaaaggggataagactcaatataaatttgaatcacttcatgaactcttatcacagaataaaaacattgttgcaacccataacttatttaagaacgcaaacgatgaaacaaaagagcttatcctttcaggtaactatactttaatattagatgaggttatggaagtagttgagcagctacaagtgaagacacatgatcttacaacactatttgattctaatcttatctatgttgaagatggatttgttaaatggaacgaagataaaagggattatgagacacgttacaatgacattagagatatggcattgaacaataatcttgtgtattttaaagacagtatattgatttggaactttccagctgaggtattcaaattgtttaaagaggtttacatattaacttacatgtttgatgctcagatacaaaggtattactatgatgtgaatggaattgcttatgaaaaatatgtgtcatcctacatagatggggaataccggttcactcaatacaataaggactttgagaacaacgttaaggaaatgatccgtaataagattaaaatatatgaaggtaacttaaatgctgttggccagttagattattcattgtcgtcaacctggtataaagataagtcaccttatacaatcaagaaggtaaagaacaatgtattcaattactttaacaacattgttaagtcatcaagtgatgaagcaatgtggacgacatattcagaacataagaataaaataaaaggtaatggatatacaaaaggttttgtttcctgcaatgcacgtgctacaaatgaatttaaacataagaaacatttagcttatacaataaacagatacgttaatacaatcctttatagttactttaagaataaatataatattgcaattgatcaggatttatttgctttatctgaattagtacagtggatatggagatcaggtataagagatggtaaagaaattacattattcattccatctttaaggatgaggaagctgcttttagaatggttaaatgaataggttaatagaacaaacctcttaaaccttgaaaaaaagtcagtcatatcaagggtttcagagcctaagtctttagggaaagggtataaaaataaattttaaaaaagggagaacattttaagtacatacgtccgtaaagaagggcgctttacgtccggttttgttcagcaagctgaacgaaaacttatataaattcattagaataaaaataaaataaccgttgataatttataatgatcatgttatacttaaaacaagttaagggaataagactttattacataaatttagaataaaaataatatcaatttatgaatggagaggttaaagatgatgttaattaaacaaaaaggaaacagatactatagatatagctgggctcaaatgagaagtttcccaattaaaaaagttgaagcattagaactaatcgaaaatggggaagctgagttagttgaaagctttattacagatcctgcacctcagcccattacagaagaaacaaagcaagtagatgaagtacaagaagaagttaaatcaacaaaagtagtaagcataaaatcaatgatagaggcaaaaaaagaaaaagatcactttgtcaagagagtattaccaaaacttaatcttactgacattaaaaagttaacgaaactttcatttgaaaaagacagtgaagggttccaagaagagattatgagaatcattctgagactgggtattgaagaagcaacagtgggatgcttacaaggaggccaaaatacatgagtattgctcctccttatgatgagtgccagattaggttcagatactatatgctatctcaaggaataaagccaggtgatgaatataaaatttatgaatacatgatatggatcaatagaatggttataaggtataagaagttaaaaaacgagaaagttaccgcaccgattaaacaagatgattttactagctttatagaagagcaggttggagttgtttaaataaaataaaatgcatattttaaacagaatggagacattaaaatgagtacatatcaagtagatttcaatcaattcagaggaagtatggaaacaacatgcgacctatataatttagataacaatacaacgcttcaaaccagcctttaccgtaatactaatagcctttgcattgaatataaggtaattcagcgtgattataattcaaatagttttgcggagtacgatacacttgcccgtggttacattgaagtacctttgacttacaatcaatttaagaagcctgtaaaaaaagtttatctaaataaaataattaacgcactagattctattattaatcaatatcttattatagaagatacttctcaagaaattaacgaacgagttcaaatgaaagtgagtgcaactaaaataaatgaggaagatcaatctgactttacgaatgaaacctctaattcaccaattgatcaaattaggatggaaagatgggacagggaatatgacgagggagttaaatatttctttgataattacgggaataaacgtataggggatattatttatattgatacacagcaagagcttgagcatttagaacacatagactgtgataatgtgataaggatttttgtagacaaagagcatgaaaataaaattaaagctattgtacttaaagatataaacaaacattatcaaagaagtggataaaacaacaattttatacatagagaggtgatcaaatgatttcaatggataaattgagcctgagactgctcgttaaaagattgagatggattaagaaaaatcctacgcacgctttagaaaggctctgctattacgaaaatgttatagaaagacagaatgaaactattcggaaacttaaacgggataaggaggcgttaaacaatggctaaatgtaatgattgtggtaatgaacgttttttctacctagaggtatcggtgcgagccaaacagcttattgatacagcaggtggagcgaggaacggaaagatttatgatgtagaccattcagattcaggggtagacaatatcttcaatgaagggaacttcatttgcaaaaattgtgactctaaaaatgtctatcatgaggatggcgaaggtgattataggttgtacgatcgagatcgtgaggagaataaatgaggattgaagtgagaaaattttcagtacatggtaaaatctacacattagcagagtatggcatgtttatgcttgaaaagagctatcaagagtcggatggcgcaacaaaaaatccatatatcatgtctacaaaggaaattgaggactttgcaattgacttactcaaagagagaatgtttgaggatgaagaagttttcgaatgtgtttagaatataaacattacaaagaaaaggagatgcctaaatgattgaatttaaaaaaggtgacagagtagagcattctagaagaggaaaaggtactttcttatcccaaggaatgtttcacgatgagtcaatcgtagaatttgataaagatagtgatgcagaaggtgaaacacttgttgttacaacaaaaatgctaaagaaaatatctgaataaaacagcagtttcatcttaaaccctttgattgactactaatttgaataaaaattataatgattctgaataaaatagaaaaattttcaaaggatgatagtgtaaatggataaaaagatatctagaaatgacccatgtttttgtggaagcgggaaaaagtacaaaaaatgccatagtgacttacaccctgattcaagagcagctcatctcattgagatgcatcgaaatattgaggagaaagttacatcttatcagaaaaaaacgggaattattcctccttgtcacaaagggtgctatagttgttgttttgatgatttctcgataagtgaagtggaatttgaatatatgatgagagagatgaagacttgggattcaaagaaagttgaagaggtatacaacatcgcattagaacaatgtgaacaaataaaagatgaaaggccagaaacgtgggaagcacttgaaaaaatggttgatgcacaagatgtcgaggcatttagaaaacaattaattgatcatcaaaaggtttcaaaaaataagtttccttgtccgatgcttgatcaggagacaaaatcctgcactgtgtatgattcgagaccgttagtttgtcgtacatatggcactactcatgttgaatcaaatgcacttaaatctgtagaattatgtgaaaatatcagtgactcggttaaacatgcaaatgaaactccatccgctgatcttgagcaatatgaagcttctttttacttaaacttaacaaccccggatggacaaagagtactacaaagaacatatcctatttattattggtttaaaattttttacaaaagaacaggtaaaaaaattgctcaatacaaccattatgataatcctcttaattttaaccaatcaattgaacaggcagatttaacaactctacgaggatttaatcttatctaaatataaataaaacatggattttaaagtgattttaaggaggcgtctagacaatgttgaagaagcttttaacatgaaaggggttataaacatgcaacttttaaggatctttattgttcatgtcttgtctgcgttatcagctgctgttgtttatgttttgggcattgattatgatggctacattccatacttcttaataagtgttattctctttatcttctatttaatctttgctgcacctgttcaatatttcttgaatcgcaattcaaaaaggtttagcctgaaatatttgcttacatacatattcttttccttcatagtgtggttaatctttgctataactactgacccaaaaaccaccatagactttctaatgggatatgaaatttacttatttagcatttcatttggtttaatcttttgggtctgggactcagtttttctgcaaaatagggtaaaggcagcagctaagtaacttaagtactcacaatccaatcttaagggagaaaagaacccttatatatcacctatagatttgaccatgagagccagatgtctatcctttttaatgttccaacaggtcaagggaaataaaaagccttgaccaatattatagctttaatgatcattttaagtgatcaaaagaaaccagaggtgaggacgattgattaaatcaaatttaaagcccatattagacgaaagaaagatcagtattcgaaagctttccagggatattgatcatgagtatccgaccgtcagaaagctttaccatgacgaaatggagcggtatccgagagagctgttggataaggtatgtacatacctaaacatcgaactgcaggaattgctgatattcgaaaaaggtcataatcatatcgatcgctcaggatgaaaatgatatactaaagttacaagcataggaagtaattacaatttttctaggtctacataaaatcgcactttcatagagaataggagaagttataatgcaaaatacagtaaaagtaaccttcaatgttaacggagtagaaataataacaaatgcgggtgtaccacaaatgccaaatggaattaacgctgacaatatgattgttttgcatgcaaaaagcaatttgaagaaaaatcttggcatagatatttttgaggttatgaatgcagagcattacgaagatatagaacatctcgtgactattgacaaatcaggatatattcaaggtgtttaaataaaatcatcagtgcaaagttatcaagaatataagtaggagagagttgcttgtttgataatcgagaagatctaattccctatatgttatctaatgacgcaaagcaaaagaacaggagttatcagagtgaatgggttaagtttgctagaaaaatgcaaaagaatccttatatgaaagagtacatattttctcgtcataaaggtagatgccaatggtgtaagaaaaatattcaaaatgagtttgttcttcatcatgcagattatgaccacatatgtatgcatccccataatatcagaataagctcttcaaataaaagaacacatctcaagataccagactgcgaaaattgttataaaacaaataggcatttgttcatggggtgtgcaagaagggtcgcatgtgttcacaatttatgcaataagttaatagatgaaagatctaagagaccttttaaacacaaagtagaacagttaaatctttttgatttttaaagctagtgcacaaatatacttgtagtatcaaagggggtaatcaaatactgccccaactaatccaaaaagtgaaggagagataacacatgataatcagcgaaaaaataaatacatccttatataaaaaaattgaaaagtgtactaagttgctaccatcgtctattcttaaagagtgctctgactttaaaattgtattttttacaagaaaagaaattgaggacaaattaaaaaacgatccgaccaataaagattatgagtatatcctgtctggtaatgggcctggtggaagtgtagataaggatactaaagaaattcgtatttatttaacttataacgatattgaaaacaacataatggatactgttaattttattggtaatctgtttcatgaaatccgtcatgcttggcaggtaaataaaaataaatatcaagatgaacaagtaattaatccttatgatgattacattgcttatttgaatcagcctagtgaagtagatgcatatacttttcaattattacaaatgagaaggcaactggggaaaatactaaaaatatttaattataatgttccaacactaccaccctataatctaaaagacgatatcatgggagtcctagggagagaaataattaaataatgactttaaaaagaatcaagataaaagaagtgttttaaacaaaaagagcattaatctaaatgctctttttcataccgcaacgccggcattcacgcaaaaatattccactttttactgagcttttgaacaatgtgtaatcgcagttgtcgcagcgaccgtattttacatcaggatactctttgtaatcataaacgattgaagtatcatacccgtttgtttcgtatttctcttccacaaaatcacctacataatttattcaacatactcaagaataccaaatttcgttcgatatagggagggaacaaatgattgaattagcttattttttaattatctggcttggagttggattattgaccggcattaagtttatttttgttgatcaggtctatgatgaggagtttaaagaactcatggataaagaaacagcagcgggcatggaaaggaatttggccagcctgtttttcaaaaataagcttaatgtgattgctttttttatgctaattggtttactgccattggcaatgaggattacaaaattatttaaaagaggttgatttatgcctttgattgattatttttatgtactacagtttgaaaataaggaatacttcaaatcatttaatttagatgaggacggttatttaacatctagcgacctccacggcgcttctaaattgcaaacaatgtatgaagtcattgaggtagctagtgaactcaaaacaaagtgcaatgtgcaatgtgaggtaagggaaatccaagtcgtaaagcgttaggagtgttcaggtgtattggatagaatggattgaaaatggagaaaagaaaagcattgttgcagaaggttggattgaatgggctgctatacttgaagacttgtatcagaagcggtttgagtatgttgaatggaagcggctttaaaaagggttgtaaacaacaatagaaaggtaaaagaaaacaggcaggggagagtgcactcgtgtttaaaacagaagtaaatgaattttctcataaaataaaaagttttaacgagaaatttctaacgaattttgaacaaaatataaataaaatgctagatcctttagattttaaatataagagtgtaatgataagtcatgggtttccgccaaatggaaacgttccacttcgtttaacaattgatgtagcaaagatttttgattattcggaaggagacaaagagaaggaattttattatcttctatttaaatattatgaccattttagagttaaatacttattaaaaagctggagtaacatagattggctaaagcgtagggttcctttgttagaggaagcagtgtttgcacacaataacgatttgttttttctttccatacctatatttctaagtcaacttgaaggggcgattgctgacggaactgggcatgttggaaaaatgaatttttctttagtaaaggataagctaaagagtatattggttaaccagaagctctttaactatgacaaagaaattgaagagttttatatagagactgtactaaatggatttgaacataatcagaacattcctgtttttagtcgtcatgcgatattacacggaggggatattgaatatggaacaaaagaaaactcattaaaggccattattttatttgattacataataaaaaaaattgaaaaggaaagtagagggcaaacaattgttaattagtgagtatttaaagattattaacggtgcaacgtttattaaaaattcaaaagttaatgacaatgtagtacttattgaatacttctcttcttttcgtgactacaaagatataaataaatgctccagtataacagaagaagactttgaaaattattttaacagcggggataaaattttgaaaattgtggttggtgaaccagcaaggatatttagggaattttcaaacatatcagctgtaataataaagcttcaggaaatttcttattgtataactagagcatctttaggttctttaacgaatttaaatataagtgatctttccacagaaaacgaatcgtggagaaactttgcaaatgaacacatttataataaattgaatcgtcaaaaattgtatagccaaataaataattttacagcagatctgcatttgagaattggccacaataatttgaccttggatcaatcattgcaagctttaaacagcaaaattgagaaaggagaagcaagaatacttaataacggaacaattgagtttgcagctccaggtacgtttgatgaaccagataaaaagaacagtaaatattcgctgtttttctttcaaggtgctttaagagcagcaggagagtttataacaaaaaaagtacttgatggtagtctgttagattcaattaaagacttttttgaatgaaaaagttgttatttcaaatgatattaatttagaagtggagaaaccaatatgactgaagatgaaataataaataacattgggaatcaaattaaagaaagtgaatacttcaaaaaaggttttaaagctggagctgagtataaaaatcggttggagagtaaagttaatgagcttgaaacattgcttcttgagtttatcggatatgaagatgagtggttgttaactaaagcaaaactaaagaaaacaaatagagaagtgcttgctgaaatagttattaatcaacgccagcttatgagggagctatataataaattagacaataaaacaaaaatagaactaaaaaagagagtagaaagttgcatttggccaattatgcacaatgaggattaaccctcattgtgtttaggtaaaataagaaattcattgatttaacaacaaataaagaataaaaataaaatatatacttgaaattctgacaactatgaggtatattataaacaagggaagtgataactgaataaaggggggagacaagttgaaattaaaacagttgattaagaacgaatgcgaaaaagataatcagcttgcagctagacttgctaaattggccggttatgaaaaagtaaatggtttttataagtttgtgaacaccccagaaaaagaaatggaaaacatagaaggtttaataaacatcgtaaaaagcttgtttcctgataatgaaaaacagctattaagtgaatacttcttagaattagaccctaacaaaaaatgtgcaagacactcggttgaatattccgatttaaatcagtgggatgagcttactgaccagttaattaaaaatctttgtgaatcaactaattcaataagccgtgaatggggtcagatttactctatacatagaagattaaataaaagtgaaattacgttaaatgatgctataagagaaacgggtaaattcagaataaaaacccctgaaatgtttttattttcaaacatattaattatgtacgaatatctgaaaattggtgaattcggtttaatgaaaagcacttcgcaatttttagatatagaagagttacctgatggatttattaaagaatgttattatggccgaattgaacttttaaaagccaatatatccttgaatgactacgaattagaagataccaggattcattgccaaaaagttattgaaagtacaaataacaatagattaattgtatttggttatttgacatatggaaacacatttatatttgaagattatgaagaagctaaattatgttatgaaaaggggatggaatacgcaaaagaaaatcctcatcacgtctacaaattagagctagctctttgctttcttaataatgtttgggcaaaagataataaatggattgattttcagtcaaacgagataccggatatgattgaggttgcctattatttagtcaacatgaaggaactagagaaagcagcatcaattatagaaaaaatcgagaaattgaatgttttggatgatgacttaggatttctaaatcatgttaaaggtctactgtatgatgatgtctccttctttcatgaaagcataaagaagttcaaaaaatccggcgataaactttgtttaaatttgcctcttattgaacttaaaaaacgtggatatacagatgaaatattgaatttaatttcactctaaatgttgacatccttgaaaggaggtgagaaaatgaagaaaatttacttcggtcttgttattttacttgcattagctgttggtttcgtaagtggtcaacaatctgttgaaactgcaagtggagatgttacagtagcctctgctagtcgtggggcgtaaaaaacaaatataatacataatactgtcttagacgtttgatccattggatcaggcgtcttttctaattttaagggaaagttccaggaattctaaaactgaaaaatgagaacatgggggaattagaatgaaaaaacaattattacaaacattttcttatgaagaaatggcaaaaggctatgaagaaatggctgcaatcaattcaacaatagcacaagaggataatcaccttgagaatgaagcggaaatggctagatcacgacataaaaccttggcttcctaagcagaatgaaactaaataaaatggacattttaaacacatcgagcacatgtgtttatttgtctagaataaaaataaaattaattattgcataatctgttggcaacggatataatgaagatacataagataacgttgttgggagatgggactatggaagaatcaaataaaaacgaagagtataaggttacttcattaagacagtatcaatacataaaacaacttaagagctttactcgtgttaatcttcatatggaagatccagatgtgtttacacctaataatgttactacaatgagaagaaatcataaagagcatatgcttattaaggatcaaaataatacaattaaatgcatataaggagaataaaaataaaatgactaacaataaatattatactgaggaaaataaaaagaaagtctggaaaaagcatatgattgttttgaaattcttagagcaaccaggaatatcagaagcatatcttaattacttgcaggaagaaattcataatgatgaatggatagggtttgaaaatgagttttttgaggaactgactggtaaacctgtgataaatgtaggggacaagattaaggcgacaaaacaatactcagctgttcattgagcaagtatatacttaaagtaggtgttttattgaatttatctattttgattaagttgctagacggttatgacttaatgaagcaaatagaaatctgcaatgcaaatattatgctgctaagaagctttaagcaagatactgattggttaaaattgtggtatgagttagataattatttaatggataaaattaaatgaggtggaaaccttggaagtgaaaaagcaaacaccatctgttagggattactccatttttaatgacataaatagatggtttgatgaattagatttgagaaatagggatgacaaatcagcatttattgaaaagtctaatactagaaccacctatgaaaggcatattagagaattctttaattatcaagttggtaaggatattgaatatttaactgaagaagatgtaataattaaaaagaatgatttaatggattataggacttatttggctaaaaataaaaataatacaaatgctacgattaataataaaatcgcagcactgaaaagtttaattaaatccttggagtcagaacacgactgtgaatcaagcgtttttaattttagaccattgccgacagagaagaatccagctggttcatttgaggggattcctgaagctgaagagtttgcagaagctgcatttatccatgagagacagaacaggttaatgaaaaagctctttattttatttagtgtacgcacaggagcaagaaaatcagaagtcttacgagtaaaatgggaagacataacgtattcatcgaagcacgattgttacttagtcaatttcaagaagactaaacagaagaaagcgagaccagtaggtatttctagctccttttatgaggagttgttaacactcaagaatgagtatggtgagcatgagctgatctttcataaattaactgtagactcaattaatgatatgtggcacagagtttgcagagtgttaaatattccacaggaaagaaatcttaggccacacagtttacgtaatacagccactaatttttcttataatgtaagcggagacattaaaaaggtggcagcattttcaggacataaaaacatcaatgtgctaaatgatcattatctcaataaggaaagagattattctcaagatcctggtgttataattgatcaagatatagatatagatattgatttcctggatactgttacattagaccagtttagacagttctttttagattgtgatgtttccactctaaaaaagctcaaaaaatttttagaattaaaataaaagtgatataaataatcatataaatgctttacttgtatgttaatgtaatgataaatttaatatgattatgtgtgaggtgatactgtggttcaggatctgttgacaacagataagcttttaaagcttaaaaataaaatagaagaagttgcatctgatattaaacatgattccagaaaagtaaaggaattaaaagcaatcatgggagcgcagtataaaacgctgcctggttatgtacaagaaattttgaataacaatgataataacattcaacgcttgaatgaaaaggaagtttatattttctctaaagaactacacaaacttactggtgtagctgctttagaccctttgagttattttccaccaaggctggctaaggagttagagggcggaagaatttttgccggtgaagaggttctaacacttccttatacatttaaaaatgtaataaaaataaatgaagataactatgtgacttcaattactgcgaaagaattaagtgaactatataatagctcaatactacaatacaactataatactcaacgggaaggcagattcattaagggaagcttaatacctgtgccaaagactaatcctaaatcagttgaagagattaaagaactttttaaaaagggcgacttaatcgtgtctatgtttacatttaatgcacggtttggcacatcagatgaggatgaagaaattgagtacaatccaagcgacctaagcttaactgttactaagggtacattagttgatgttctagatggttaccatagaatatctggagttgttaaagctattactgaagctcctgaattagatcaaacctttattttgaatatcttaaattatactgaagaaaaagcaaaacgtcattttgcccaaatgaatacaataaatcctgttgagaaatcaaggattgaagaacttggtcaaaaacgctattcttccactattgttgagcaacttaaatataatagtgaactcaaagacaaaattagtgtacaaagtgaaattggtatgagtagtccattcttggttacttattatacactttctgaagcaattgacgatgcttttgagatcaattcacggagagacgctattcaactgtccaagtatttaagggacttctttgctgagcttttttatgcttttccagatgatttccttgaagatgatcttagcgagtcaagaaacagatcatacattaactataatgctgtattttatggatacatttatttggccaaaaaaatgcaagagaatggcacaccactagctaaactagcaacgatactacagcaggttgattttgataaaggtaagacattcaaggagttaagcagcagaaattatgaagaacaattaaatgctgctatgaagaaaaaactgaaaaaagttttctatgatgaaattgatgttcgttaggctaaaggagaaatagatatgagtgaactatacaatgctgaaattaaagaaaagttcttagaaagatatgaaagtgaagcaacaaaagagctttaccgattaaaactcagagatttttcttttacagaaaggattttggataaagacatatttaatttctctctagaggaactacgcactttattttttgacttagatagcaagtcacttgaatcattaaggggtgcacgtgctgttattggtcaatacactacatgggcaatggaacatggtctagcaaatagtaacatcaataaagtatacgaaataaaggacgaggatttaaaacagtttatagataagaacaaaaagacattgtttacgaataaggaagtagaggaatacgttagctatttattcaataaccaggataaagcaatggttcaagctgtatatgagggcatagacggctatcagcattctgagttaattaacttaacaataaatgatttacttgatgacaataaggtaagacttcaagatgataaacatggcgaacgaataattgaagtgagcgaaaaatgtcatgagctgcttaggttagcatatgagcaaaacacttaccatttaaataatggatcagcgtcaggtaaactgaggtttgctaatttagtacgaaatgaacacatttttagattaaaatataaaagtccagaccaaagtatgcaagcggataagttcttggtacacaggtcttttaaaacgtttcagaagatactagaagagccttattttacacctaagaacttagctaactcaggaaagttgaatatggcgtataagatttataaggaaaagaaagaactaactgtaccagattataaaaagataactgctcaatatggatttttgaatgagaacgctaaattcgcttctcaatcattaagaaaagttatcaatatggagaacatagaaaagtattgcattcaatctgaaaagattgtcgattaattaatcccttgatagggattaatcttacataacaaaaagagtaaaaataaaataactaacacaaatatgagctaaatcgtgacatttaaatattagatggtaggattttgttcgtattttcagaattcgacaaaagtagacaaagacaataggggtaatttgtggtaaaatcagactataccctaaaaagggtacagggaggttcgctagggcgaaattcctagcgattttcaatgtttgattttccattcatagaggtcttcgagggtgcaatttagtgctacagctataagtttggctgttcgaatgttcatagaaggtctaacgccattagcgtaatcacttagcctttgggtactgatgccggtgatacgcgaaagctgacctaatgaaagccctcttttttgaaggagatctggaatcaaacattgtccgaattctacttctagcatcggacaacctcctgattttatgtatgctccttatcatactatatcaattcttacctgatttttaaatgatcaaaaaagaattgcagactaataggcaaaagggtataattaatttaatcaaaaaagggaacgtatgtttggtcaattactaccagagagagggaaattaatgaaggagttcattgtacaaggggattttagtatttcttatcatggacgaatcaaagcagagaatgaagaacaagctatgaatttagttattgctgtattaacaaaaaaactgagaaataaaagcgggaaaattgggtttttagagagaggacaatcaaattacaatcatttatttgatgttgatataaattcaacggaagatgctgaaattagtgcttcttatgttgaagagatcgatgaaatgtttgatgaatcactcgaagaatacaagaactcagaattgtttacagcaaagtgaaattcacacatcttgtcagtcatcatgagagataaaaaattgatggctttatagtcagactggagtttaaaaatgaaactggacattgaaattgatatgagagataacttagcagcaattatctttaacgttggatctgataacatatcaagtggagaatattacatagaaattgactttcagaataaaggcaataagttaacgttgaggattgacagggctgcactgttggatcttagagataaaattaatgaaactctgtggaaattggacgatgctaaaacagtattaaacagtggctttactatgtaagtaaagcttgttttttaaccaaattaagaataaaaataaaattactatttacatatgatcccatgaactgtataattcaaatcataaagatactaaagaaaggagatgtcgcttttatttgattaatgatccgcagaataaagaaataaaaaacatggtcatgaaaaagtttttaaaggtttttgcttcatgcaacagagctttacataacttaaataaggatgaaataaggaagaccattggtgatttggactttgttaaggacaacctcgaagaaatacagtttattttaaaggatattgtttttacaaatgaagagagaaagaatgaaatcattaagaatcaaaataaaatgtaagttttattcggactaatattttaggagggaaaatagcgtgaatctacaaaaaatgttcgaaatgcaaaaggcgcttgatgaacggatcatcaaagaaaaggggctggaaggtcagaacttgctgccaaacctcattcttgctttacaagttgagttggctgagtgtgcgaatgaatggcgcggctttaagcattggagtaatgaccgggagccaagaatttgtgtaatagataaaaagggacagactgtaaaagaatattataaaaacccactgcttgaggaatacgtggactgcctacattttgtcttgagtattgggaatcgaattggatatgcacacgaaaatttagggaagtggactgacttcactattgtaaaccagtttaaccacttgtttggatatgcatcggacttatataaagcaatacatgaagattggtttgaagaaaagttatttgatacttacgatgagttttttgcgggttttattggtctaggtaaaatgtttgggttaacgcatgaacaaattgaagctgcgtacatggagaaaaacgccgtcaatcatcagcggcagcaggaggggtattgatgaacacagcatacagagtttgggacggccacgagatcgaggaggtaatagaatgacaatcaatttgaaagtgaaacaagagaagcgcaaagggttatcaattaatgatatccaagatggatacttcattttaagaaatgatgatgttcggattgtgaaaatggatgttacaaatagaaataagatacatttaatcgatttaaagacgttccatgttaaaactgtatcaacaaagaacgagttgaaaagtttgtttgaagattggagccgaattaagatattaagcccgaaacaggtgaatttaaacatcgggttccagtggagagagtaaaggagacaaagaaataactgtcatccccgaaactcatatagttagggaagtttatgaatctgacagggacggaatgggctacctattacgtccgggtaattacgattttaaaaattgggagggcgcggagtgaatgacttccaagaaagaaaacaatttttagagaagtactatcaggagtttaagtcactgcgagagattaatcctgccacgtctttggatgaagcattgtcattgttctgtgttgcatttccagaagcggagccccacagaaactatttttatcaaaggactttgaaggagggcgcggagtgatgaatgcaaaggataaagaaatgttcgcatcgataaaagagaagcaaaaagaattagcaaaggaatgggataaattttgtgaagaaccgggatacagaatgccagacgaaattcaggcagatattatcgaaaggatgtttttgattcattttgttgagaagtatttagaagccaaagagaatactgaaataaggcgtattgaatataagttttggtacgaagttgagttcggttggaagcatttcagtttcggcgccaatgatgataaaactgcattggaatacgcggaggaatacgcaaataataacaacctcataaattataaagtggaaaaaataacgaatgagagattgttttggactgaggagggtgtgaagtgaatcctgaagaaagtaacgaattgaagttacgaatgattacgccagagggtaaggaatttccggttaactcttcacccattgaaaattgggataatgatatttggaaagcgtttgatgaccagaaacaggttttcgacgcagagattaaaaaggcatttgaacactgtaacgtaccactgaaggaagcaattgaacgggctgaattagccatagataaggacgacaacactgttctgacaatagacaaacgaccggttttaatctcatataaacctgaatttttatattcggaaggaaaagcagtacagagattcaaacgactttatgaggaggatgcaaagtgagtaggttaaatggattgattacagataaatacggtgatgcgttgtatagaatggtttttgtataaccattgaagagaattcacactctaggatgattacggcagatttcacattgaacagaagtcaccttccgtttttaaaagaaattgtaaaagacttggaggaagaagcggagtgatctgaggttacagtctagataaaagatgcattttaaagtgaattagatgaagtaaaggagatgaaccgatggaagcgttacaaccaaatcaatattttgaaatgattaaatcaaagaaaaataaggttacagacaaagaacttcaaagatattacgacaattgcttggtgttactcaataagtataagcaaatcaatcaaattaaagctgcaaagaaactgatattccatttagaatcaattgaaaaagaacgggagattgtaaagcttggtattgatacgtttgtttatcgggatgacattgaagaatacatagataacattgcaaaagatacagtcaaaattattgagcttgaaaattacgaacgtgaaatccctgatgaggtaatcattatatacaacaaagtgaaagacaaattggatcggttttatgtggtgtttacagattatacggggaaggttgaaaggcagatcgaaaaagagcggagagataaggatccaattttattcggcacttttcaagatgagtcgagcggtactttgattgaacgtttttatttcataggcgactgggaagatgagtattgtgatctcactttagataagatgatttccgaagtacaggaagtaaaagaatcaaatattgcaatgaccatcaatacaccccaagatatcgagcaattgaagaagcagttaaacaacatggacaagatagcaaatgggtttaggatgaataatcccggatttggagtggttaacgaaaaggaaaattggtttaaaaaactgttcaaaagggcgaagtgatgaaaagaacagttgaccttactgaaaatagagagttcatgaagattggaagtaaccaaagcaagtcattattgcaaaggtacttaaagaagcgaatatacccatggagtgtagaagcagaagtaaggcagaacgacctttatagtagcagcttattgttaactggcaatggttctgaaaggggaaaacaaaaggagacagcagcctttgaaaagacgtgtcattgttgtggtaagtgggactcattccatatgacgataactaaatcaactctgtgtaaaagttgcgaagaaatgcttgatcacagtgttgtgggcaatgtcccttggagaaagcagtttggataaaaataaaattttaaagagaaaggaagaggagaaatgattaaagggatggttaaacatgaactacttaaaacaagtgatggtgttttaaggttggctgaagatacactgtgtggcggtttttctcttggtattagaacgcctgaaggagctgactggagatatattagtgatgaactcggacagttgataattaaggagctttctgacgatcagataggaggcctcaagaatgaaaaataaaatattggttgttgatttaaaggaaatgattgaaaataacatttcacaaagaggaacagatggcactagatattaccggatcagtagagatcaattagaagagattattgcagcattagaaaactaaataaaattgaagtttcatagaaagtggacgagagaggaaaaggatgaataaaacattatagaaggtcatcaagagtcctctcgatgacccgagaagttattgctattctttaatttatctttcgctaatagtggcagtaatggatccggaagaccaagaatcagttaaaaaattacttgaaagaacgtaagtttcgtttttatttaaccatacatcggttgatctaaatggtttattaaaattaccagcccctacattaagaacagcaacattttcaccttgtcttgttatctggcaggctccggcgtatgcctcagtgattccaacatatttgcaagtgaatttcatatacttacctgcaccagtaatcatcttagtgctggttcctgaagatgaagttacacttccagttgtagctgcactagcagaagaaacaaaagccgttaaagtaaaaatcactgaaaaaattaaaacgaaaaactttttcattttacacactccttgttttttaacttaatttttaaatattcgacattttggactttatcacctgtaaaaaaatgtagaatttttgtaaataaatgttcaacaatgattagggaaaatggattgaagggtgctagttaaggagcaacaataaagatagttatagaaggatttataaagatgaaaaccctataacttgtgtacagttcagtttatataaaaatagtattgttaatgagaatcggaggatcaaagatggagaatgatgttttatacggggtttatagtacacgatcacgaaagttttgctttggaattgaggagccttcaaaaacaaaagcaagaaaagagctattcaatcgaattggtacagatgcatacaaatggcgttttgaaataagaaaaattaaaagaaagtagatggaaaaatgaaatttgcaccaatggataaagttaaatttaaaacagctagtcatctcaacaaacttcgaactttaaaaaaaagagtccctgaattagacgatcctttactcggcgaatgctgggaatttgaagaagatgggttaaaacaatttgattgggaggagaactacgaatttgtcgctagacccaaacattttaattgggattaaaaacagagtctaattgaagtttaatgaaaatcgggggaataaaaatggagaaaatgaacctgctaaaagaaataacaatatttgatttaaataaaatcaaacctggcacaaaagttcaagtaacttggtataaaggaacagagatggagtatacacataatggcgaagttatcatcaatcacggagaaaagttttactataatttcgttgataaagaaggctatgtcggccattgtcatgtaaatgcacttgatctgaagaactatccagacagtctaattgttgagattaaatctaaataaaaagactgttttaaagaaaagggggaaagcatatgaaggttaaaaataagagctgcgataaggtttatgttgaaatcaatggagaaagggtagatgtaaattcacttgaagatggcagtctatctctagaacattataagaataccagggcgaattctgatggatttgaagcactttatcccaaactaaatgatgaagcgcttatacacgctgctaagaaccacctgaagaacatccttttaaagagaaagccggttacatatgaagagtcattagcagtatgtattgctcccgaactaattaaacgattggaattcaaataaaaggattactttatgcagaatggagggcaaaaggtaggatacatcaaatacgtatttgaaatcgcctggtttaacttagtttggtttaaatggcaccttggagcggacataagcatttttgacagctgcggatggaatacatataaacggataaagaataaaaataaaataagcggaggttatttgaatgataaagacgaatctgcatagcaaccacgttgatgaaattataggtgagcattacgctgctaagggatattcagtccagagcattgatcgtcaggataatggccaactaattattgttgcgcaacgagaaacagaggaaaggaaagctgagaaagttgatttagcatttgatttcatacataaaagaccgcatagaaagaaatatcttgcttaaaacaagtaaaaggagctaaataagcccctataagtttaaacaacttttgtataaacagccgtataaaactgaattgagtaatcgaaataataacgtgtaagagtataagtatatccattgtattcaatagaaggcttgaagtttggtagggggctaagctgatatatggtgtcataatcatattcatcactttttactactacttcagacgaagcatttgttgccaagacaggagcagcagataccagcatgcctaatgataaagcagaactcaataaaatttttcgaaggttcaaatatatcaactccatttacattttatatattaattatgagttaaatggaagttgctttggaagtgaataatggatcataaaatcctgttttttaaagctaggaggaaacgaatgaacaaagatattcaatttttaaaagggcttcaaaatgaattgaaaacacaggatcgtgattctcaagctgcaccacggttttggacagtcggtgattatgaatgggtcgaagctcgagaggaaaatgcagaacgatattctgtatacttgccatatattgcagaagcatatgttttagatgattatttagaagatgtaaaagaagatagtgagctttctaaggaagccttaacagagttgcaagaaattgaggacgactatgacgatgctattgagtggattcaaaaatatattgatgaagaagcagaattaattccagaaagaaaggtccacattatacaaccaaatacaatgtttttgaccaaagcagaagcaaagagacacatcagattgaataagcaccattacacttcagaagctcatacttacgcaatgacagcttggagagcaccgaaagttgagaggctgcttaacatacttgaaacgtttgattggggttcaattaaagacactcaataaactctataaggagaaagtaaaatgaacacttatgaagtcgatgacagcaagtataaatgtatttatgcaggaactgaaaagtagctgcttttaataatgaatttgaaaacggaacaagagtaagggtttggttcgaaggcaatcacataaaaacatttgaagtttgaggttccggaaggatacgaaatgcaaatccgacctcgctccggcattacgctgaagactaaactgcgcgtacagttcggtacgtagatagccgatataccggagaagtaggagtcattgtcgataataataatcgagatacggacgtagaaaaggtttcttatcgatatcagcaacaacatcgtcagtgctcacgattacctcggagcttgggatcattactatagaggttcgtacatcatccgaaaaggtgatcgcatcgcaaagccgtaatcaagcaggtcgaacaggttgtttttccggaagttgatgtgctcggcgatagctattgagatgcgggcggtttgggtagaagcgaggttagttaagttcaaaatgttttttaataatacttgtggcgatatcttttagtatttcaaaagatactccagtaaaactcgcagctttctttttagtttgttcccagactttgttatccctaattgtctctaaaaacatatgaccattgtaagtcatttcgcaaatttctaatggagaagtgctcgctatcaggtatccagcttctattagtttcttaactgtatagacaacttctagatattcgtcctcatctcttaaatttaaagaattgaatactttcgaaattcctgctgtttcaccatattttagagtctcaacatatagaagtaagtttcttactagatctgcttttaattccaatgagttcaccctttcaatctctttaatgaaatctatattataacatatttataaacttgaaggaggactataaatgacggaatctgaaatgaacgtactgctaatcgaacgacaaacttaacaggcttgctgattacggattaacagaagaagaggacgatgcaatgacaaatattatgaacgatttaggacttgattggtgatgaattacagaattaaaataaaatatttattttatttaaaaggagtgagtgaacaaatgaactttcaacgagagtacttaggatattgcatacataatactgctgacatgctctggttgtggtatgactatcacactgagatctttgacaggtcactgccatatacggtagcagctccagatgatgaaactgcagtaatgccaactcgattcccgtatacaatatggtcatataataatgcacaaaaactgttaaaagaaatttattggatcgctaaaactcatggagtatctgcagaagaaatgtttcaagcaaaaatgagcgaaattagaggaagaagcagttcacaaaatcggattgatttgtttttagaattagataaaaaagggcaatttgaatttataaaaggcatgagcaattaattcactaaagttcttattcggtaataactaattgatccatgtactaaatttttaatgggattttaaaagctaggctctaaggagttatgtaacggagagattatcctctccaggaatcgaaggaaggtatgcggagtttgccgtgcttagtcttaaatctgtgcttaaccttacataaaataggctcaataaatacatattcatcagattcagattttacttgtttcatagagtggaacttacttcgttctgcatgtggcatgaattccataaacccagctgcagtgccgtcaggataagacagaaggaattttatatccttcttggtgtagccggttatgagaacctcagtgtaatcgtaattgatcactttcaaccaattatgcgaacgtttattgatctcataagaggagtcagctttcttgtgtacgatgccctctaagttcttttctttggccaggttaaagtaagcgagtccgttaccttgaattccttcgagtacaaagacattagggggatttaactcaagtgagtttagaactgtcttacgctcagtgagcggcttggctgcaattgactggccgtctttgtaaataacatcaaagacacagtaaacaatcttatgggctgattttttggacatgaaacgttccattacagcctcaaagtcaggagcaccgcctggggcagctacaataacttcaccatcgagcactgttccatctgggatatctaaatccaggagttcaggaaacttgcttgttacttcattattgtgacgagtatatagcttaatctgattatcaaatttagaaaggatgagtctgataccatcaaatttgagctcagtgatatagttatcgtcgtcaaatggctcttttattgaatgcaatagcattggcgatacaaacaaaatatcacctcctacttagaccatattagctaagcgaaggtgatatataaagcgaaatggcagtggtacttaatgggattcaatgagctcaggtgaattgtttttaggtgaatttactaaagatgaaacctggtatgcttccatgtcatcatcataaggcagcaataagctttgtagataatcaggatcagtatttttagggttgagccattccttttcgttctcatcagtaaggataaccggcatccgatcatgaatgtcttccataagttcattaggctttgtcgtgatgattgtacaagtgtataaaggattgccttcaggcgtattccacttctcatataaaccagcaaaagcaaagagattggatgatttaagtttaattcgcattggaatcttagtctttggatcaaggcgtttccattcataaaaactgtcagcgggtatgatacaacgtttgctgacgagcggctttcgaaaacttggtttctcagccaatgtttcagctcgtgcgttgatcattttataaccgatcttctcatcttttgcccaaggaggaatgagaccccatctaagtttaccaagacggttattagagccatcgttgattattgtcaagatgttttgtgaaggagcgacattatagcttgggtgatattcatcttcgggtaagaattgatctatattgaattgctcaatgatgtcatcaaactcagaaaataaagtgaacctgccacacatgttcatcatcctttagggtttttgaatattgtacaggcttggtacatgaaaatcaaaaaggaggaatgtgatgctgcagcaaacagttgaggttaaagaagttgatgtgttgatcaggggaatatggagaaagaaaaagttcaccgatattcaaaagggacaaacctttaagattgaggagaacggaagaacaaagaaatacatagcgagaacagatccttattgggatgacatgtatgagacttacattattgatttgttggataaaaataaaattagaagaagtaagtaaacagaaatctagataaaacagagattttataaagacaaaaataaaattaaaaaaggagaattttgatgagttatcaatttgaaaagaataaactgtacgcatatttaggtgaagagttagttgaagcacttaaaaggaatgaagctattattgcaggtggggcaattacaagtctatttaataataaagagataaatgatgtggatatctattttagaagtgataaaaaagcatgttcattcttagaagagtgttggaatagcaatgtctatgtaacgtcacacactaaaaaagccacgctttttatcaaaaaaagactaaagctacaaatgatccactttaaatttttctctgatgctgagtcaattttcaatacatttgattttacagtctgcatgggagcttttgattttaagaccgaagcttttactctacatgaagattttttgaaacataactcgcagagaattttaaagtttaatagccaaactgcttttccaattgtctcattgttaagagtgcaaaaatacacagataaagaatacacaatttctaagccagaattcattcgtattgtgctaacatgcatggacttaaccattaatacatatgaagaattgaaagatcaaatgggaggtatgtatgggataaactatgacaaattgttcgaagacgaaaaagatgaagactttaacctacgagaagctgtagataaaattgctgacatggttttagacgaagattactttaaagagccggttaatttagagtttaatgacttagacgatcttttaaatgacattaataagagtccagttatgacgctgaagattaatgatgatcagtacagaattggtcttgatgggtttcttaaagaatctgtatcagcgccatgtactgaaattaaattagacacaaaggatttcttcgataaaactaatttctataaatttgtaagaaaacagaacggaaaattgacgagcttctatgacaagaactttgagtatgtgattggggaagaagctaaagcggaaggagtaatagatagttggtcgaacagcggaaagttattttttaatgaaaaggcagcgatcgaacaatcaacctactatggaaaggaagacggagtacttattgaggtgaagataaaagaaaaggattttgtagatgcggataatggtaaagttgaggccacagcatgtcaagtaattagagaagtttcaaaagacgagtggaaagaatacataagtgccaataactctaaataaaaacgatactttatcgagacaggggaatgcttgttttttagttatgttactgaataagcatgttaataggcagttaaagcacatacaatgtctgttgataaaatgagaatgagtctgaaaataaaaagcagatacagcaatacacaaactataattaatgcttttattgaatgggttgattatatgagtggacaattatgacagattagttaaaaaatattattttatagtttaaatggatatatatggggtaatagccgaatgtacacataattttacatttggaggaggattaccatgaactctacgatttgtaaggttggtattgttggaatgttgtccattggcgggttgctttctccttttgcggctggggcggaagctaaagatgaagctagaaacaaccaaacaactacattaagtgttaatcaaccagttaatgtacttaaaacagcatcagtgcttaacagtcaaaacagtaaaccaactgctgatgactgggaatcagctggaaccgaatatggaagtacaaagtttgaaaaatattctttagctgcagttgttcagacactaggatttgcattaaaccttccttcagggggatggtcatcttacttagcgggtttagcaaatatggttattttaggcgaatatcctgttgtttattttaaagatcgtaaagagtttaaaatggccggagcgacactaatgacacgccacaatgttacaatttatgaagacaaagatcgcaagaagaaaattggctcagatagctttatcattacagatagaggtggcccaaaagctgctgataaatgagataaacaaaaaatcctccctttctgggaggattaatattacatattgactaaagtgtaagtcaatgaaacgatgaataaaaaataagaagtataagaaattgcttttgaagagcttgttttatgtctttggaatgtatagataagtgcaaaacctaggaagaaaagtgttacaaaccaagaagtgtattgtggaaagatagcaaccagcaaaaccatgattgttgaaaaaacaaatgaagagtaatgagtaactttatgttcattattcaaagaaatcacctccacagatttttacccaattcagtgtgtgttaaaacattatacaaaaaggagattggaaaaatgccaaacataatttctaaagagcaagatgaagcaattaaatactttagaaataaattgaatttatcagacaaagacttatacataccattgattaattttgaactacttagagacaagaacgaacaatatgcgaacattctttatgagctgtataaaaatgatccttatttgtttattagagctttaaaggaaggttatgtggttaatcaacctattgcatttgatgaggccattgtgcgattctttaatggagaagaactggctattgtacataaaacaaccggcagaagatacaatgtaaatgtgaaaatgaagcagctacctgatggatttacattgcaaacaatggatgtatggttatggagtgaacttgtttacatattataaatccgtgatataattctctttaatcctaagggagagtataaagggttttggggaataaaaagcaatattattgggggatgagctaatatggaagttagagtcggaggctgatcaactctggagctgccactaggtggctcttttatctataacccaataaaattatcattttattttaattacaaaaggaattgttaagtttttcccctcatggtaatatgttattgaattaatgattcttttttactatagggggataaacaacatggatcatgaggctacaggggagttacctttagaaaagccaaagaaaactaaaaaagttatttggattgtttcagtttgtgcggtggtggcacttataattggaggaatctatggctatcaagtttacaaaaagaacaaaaaacttgagcagctagaagcgtattctaagaaagaagaaagtcttgtcactgatatgacttctttaggtgcaagttcagaagaaataattaacgaagttgagacaacttggcatgatgttatttttaatgacctacataaagtaaatggaacatatgttagcgattttaatgatgcattagttcagctttacgcaggttatgaagatgaaggtaagatttctgatttagaagatactcaagagacaattgaaaagcagattaaatcgatgaagaatcatccttctgaattcgatgataattatgattatcttcttgagatatataaaaacgtaaagcaattgtctgatttggctattgaaccaaagggaagtcttgagacttataaacaagaggctttggataccgacaatgctacttcatctgcaatggatgattacgatttgaagaaagtaacctttaaagagcttaaaaagaaatacgaatagctttacccaaggtgttccgtttagaacggaacttctctttaaaattatttagaataaaaataaaattactattgacgataatgtgagcgtgatgtaagataagaatatcccaaggagagaaaggaggtcgtaaagtgaaaaaggaattgaagatattgaaaattaaaccagctgcaattgaagcctatagaaatgatgttaaaaggaattatgacatcgaagaagaccaggctagaagaaaattaacaaggaatgtaatgttggtaaaggaatttaggcccgaaggaattaagaaaggttttatttcaaagacatattcatatggaaatctaaagatcactgtaagacataatacgatcattaaagtaagaaacattaaaggcgatccggagccttggcattttcctaagaagagatacatagagttaaacaaactacttggtattagagattgtaagtttagtagtaagtcacattatagaaataataagaataaaaataatatcatttaattacggaggaatagtgttgagcaaacttcaaaataaatttgaatttattggtaatatattcatttcaaacgacaaagagaaatttcatgaggtaaaggaatttgatagtggctgggttaagaatagattaagctttgcagttcaagaatctaaaaccaatagcgtatttgttgagttggaaggtggttattcaaaaagtaaacccaataaagtctactctttcagtaagggaactgaaaataaaaaaggatctaaacttgaaattccgtgggaagatcggttaaaagatgaaactgtaaatatggttgctgatttttcaaaaattattgttgattttaatgatgaatctgtaaaagaaaaattaaatgacttgagatataaattgagaggtttagataataaagactcgttaactgaagaggaaaagaaatcacgttccaaactcctggatgaatataaagaattaaacgtaaatggagtagaattcatccacgaatatgatgcaattcaattcctatctgaaaacctagaaaagtataaggataaaaaattcaagattacaggaagtgttgaatataacacttggaatggccgtaattttagaaagtttaaaatccaaacaattgaaattgtaagcaatgatacaccatcacagttaagagctaatttggatgtgttttatacaaatgattcactggatgaatcatcatttgatgaagaaaaaaagtacttcattgatgcatatgtgcttagttatgacaatcaggcgaaaagggatcgtttctttccacaacaacttgtaatcaatgcgaaaaaacttgatttcaataatgaacttcatttgaagagattagaattacttaagaacttttttaaagtagatgaggatggagtttatcacctactttgggaagttaacatttttagaggagcagatgaagtagattttactgaagatgatctttctccaaaccaaaaagaaatgattgcactcggtttaaatacattggatgattttaaacctaaagggggaatgttaggagaatcccgtgaagaaaaccgacttttaaaacctattttaaaaaaggtcaatgattccaatgactttacagaaggtgcattaacaagcacctatgaagttgaagatttaacatatattccgcagcaagctcaaaaaactgccccatcagaaggtaaagaagaaagtaaagtaaatgaagaagaaaaagataatgcatttgatgatttatttgcttaaatgaaaaatcaattttacctcagtatcgttattacataatacataaggagttgtcacatatggcaagaaaattcggaaaaaagaataaaattaaagttagtccgttggactataatattggacttattggtgaatcaggtatcggtaaaaccactctagccaaagaagtatgtgaaaaattagttggtgaagatggttatatgatcctcaatattggaaaagaggatggcgttgatgctattcccaatgcttcttatgaagatgtccctgattggataacttttaatgaaatcactaaggatattatcaaaaacagaacaacagactatgcggatttaaaggttttagtatatgacacatttgatgagcttattaaaatcacagaaccagaggttattcgattacataataaagccaatcctgaaaaaagagtaaatacaatcaaagctgcttttggggggtttcaagcaggggaagataaagctattgagttaattcttgataagatgtgggaactaaaaaaagtgggtatcagcatgtttatcttaggtcatacaaagaaaagaacaatgactgacgtagttacaggtctagaatatgacatgttaacaacaaacatgacccataagtactttaattcaattaagacaaagctccacgttttaggagtcgcttctattaatcgttctattgaaaagaaaacagttaagcaaaaaattggcccagacaaaacaattggaacagttgtggatgaatcacgaattattacgttcagagatgacaactttaatatcgattctaaatctagattctcagatatcacaccttcaattgctttagatgacaatgagtttatcaaagctattcaagaagcgattcatttagcttttgataaacaaaaaaataccactaacaatttcgaggaagaaagaaaagaacaagagcaacttaaagaaactaaaattcagaatgaagctaataacgcttcatttgttgatcaagaagagaatgagaaattagcagacgaaatcaaaaaactgtttccaaatgccagtgatgaggccaaagagaagatgaaacagattatggatcagtttaaaatgaaggatttcaaaggcgtagacactattccaactaatgcatttgaaaagatagtcgatgcgttgtctaactgaacacacataaggggagcttagctccccattaaattaattagggagtgttttcttggctagaaagtgtgtatgtcaattatgtaaagcaaatggaacagtagatgttttttataaggttactgatacaaaaggtaggaataaatattattgcaacaaagatgaatatgaaaactttaaaaatgaaaagctgaaacgcaaaaatcttttatattacctttctaaagaagtattccactataaggatggacaagtgctgccacctgtttttctaaagaagataggtgaacttaataagttttatgattatgaagtgatacaaaaatgctttgagaagaaccaagaaacaattcaatattggttgattaacaaagaatttaacaatgaatttggaatgatcagctatatttttaagatcatagaaagtaatatcaatgatttctataagttatggtctctggaacaaaaccgtaaaaataaagaagaaaataatcaaattgatataacaattatgaatcaatttaatgattcaaaaccttcatctttgaaacaaaataattccgcgaaaaatataacagcgtttcttgatgaggaggataattattgaacaacttagattcatatccggctaaactagtggaaaatagaggacaaattgaaggaagttttatattttgcttatggaaaaatcctgacttatatgaagactataaagatgaagttagagcagacagagattttttgacggatgatggtaagttttattactctcttggtttggaactgagtaacatgaattacaaaagctttgatgatgcaagtgttttcagctatatagaaggtaaagaaacattaaagaacggttttatccgaagaggtggtatgaaaactgtagatgagctcaaaaacgtgttgaacgatgaaaacgttgatacctattatgatgagcttataaaatataatatgctgctcaagcttcatgataaaggattcaatgtaatacatgaacttgaaaaattcaagaaaatgacaagtcagcaattatacagttactttgaatttcaattagataatgttttcttaggtcgcggatctggagtgaaaattgaagagctcgacttggatgataagtttgttgaatctattgaaaacggcgaagaaatgggattgagttatgcagcagcatgtcctttattaaattatcatacgctcggtcttcataaatccaatgttcaaatttttgctgggttcagtggaactggtaaaacaagcttttgtgtatcttcctatgtgatgtcaattttagatcagggagaaaggataacaatcatagccaatgaaatgaacaagagagcttggcaacatatgttcatggcaacaatattaagtcataaacttggttactatggtttacctcgaaagaaacaaaaaatgggtaacctaaaacaagagcagagagaaatgctgcaaaaagctgttgagtactatgagaaatattataaaggacgcattaagtttgcaaaaatttatgattacagcattaatgatgtaaaaagaattatgagaagaatggcaaaacaagggtttggatacatgctttacgatacatttaaagcagaagatgcttcttctaataatgtaacaggggaactaattgaagcttccaaacagctcttacaggttgcagagaaggaagacatttgtgtcatcattacaatgcaattagcaatttatatggaaaacacgagatatttaacagcatcttgtctttccaatgccaaggcagtaaaagaaattgtatcggagttagtacttacaagaccattatgggatgacgagtttccaggcggaaagtttgatgttaaaccatatagatttaaaaaagactcttctggaaagtatacaaacattaaggaagaaattcagttagatacaaacaaaaaatataggttattctttttgaataagacacggaatgatgaaggagatacagtgttactttatcaattcgatggtgcctggaataaatggattgaacttggctattgtacccctaagcatcagcgaacatcagagcggacatgattaccaaaggaaggtgagatcatggacgtatataatcttaaaaatcatattatcaaaaaaccagaatacatagagcttattttagaagagacaggtttttataatatcgataacagaggaaacgaatataggtgtgcaagaaaagagggaagaaacccgacttcagttaaaatcaataaaacaactttaagtgcgatatgttactcaacaaatttaaatggtgacttaattacacttgttaaggacaaattaggtttaacttttcctaaaacaattaacaaaatagctgaattaattgactacaaagatgaagagcagtatgaaccacccaagattccatttggaggattttataagaagataaggaaatttagcaatcccatcgatatagatcttgaaacatattctgaagacatattggatcagtttgaacaaattccaaatatgttattttataaagatggcattttaccaaaaactcaatctatgtttcagattggctatgatagtgttacgggaagaattaccgttccttggaaaacatttagtggtgagttatgtggtgttatgggacgtttaaataaaaagaccattagtgaagatgagaccaagtggttaccaatcattccttttccaaagtctaaaacgctgtatggatttgttgagaattacagttcaattagagaaaaaggaataataatgcttggtgagtcagaaaaacatactatggctttatccagcaaaggtttgaatgttggagtttcattaggaggcagcttcttaagtgaagttcaagcaaataatataaaatcgatgtttccaaagaagtcattaataatgatggatgaagggcttgatgaagaacatagtttaacaattgctaaaagccttaagtttgaaaactttttcaagaatgaggttggatacatattcgatcgagagaacaagtacctgccgaaaggttcaaaaatggcaccggctgatctagataaaaggagtcttgaatgtttaataagagactgtacggtatggatataaaagaggggatgattgattgaaagataaattaaatgaactaagggaacaaggaaaaaacatttattccttttccaagcttggaacttttaataactgtgaatacgaatattacaatacatacgttttgaaaaagaaaggtatcgataacatatatacccttatggggtctgaattacataatggaattgagaagatttataaaaatgaattagacattaagaagtttaaaaagaactttgaaaatagattaattgaattagaaatgaatggagttagttttccaagtgaatcaatcggagacagctggaaagctgatgtcggtcatttcatgaacaacttcaataagatcgacagtaaaatgattttagagaagctaatggtatttgaaatcgcagaaggaatttaccttcagggttatgtggatgctattcttccaagtgaaaaaggtaagccgtatgtaagtatttatgactggaagacatcaagtaaatttactggaaagaaacttaatgaggcaggaagacaattgttaatgtacaagcttgcacttgagcagacaacaaatttaaaagtggacaaaatcctgtggttcatggtgaagtatgtttatgtttgtacacatggaaaaaccaaagtaataaagaaaatgtgtaacagaggtaaatgggtcaaggaaatgcgcaagcaactggaaaaacaaatgaagaacctcagatatgacgactttgaaattgagctaatgttagataatgcagtaaaagaaaacaccctaaacagcttacccgaagaggttaagaataagttttggctcgaagattgtacagttgaatatgaggtcacagatgaaaaggttaatgagttgaagaactatattactgacactgttgagaggatcgaaaataaagatcgtgaagatgagaaacaatggcagccagtaaaaataaataaatataattccttttactgcagtgtattatgtggacatcgtaaaacatgtaagttctataaagagtttttagagtcaaataaatttgagaaaaagaacaaaactgatatgtttgataacttattttcttaggaggatttaatgagaaaaatattctatgactttgaagtcttcaagcacgactggatggttgtcttgattgattatgatactaaaaaaggaaaagttatcgttaacgattcagaagaacttaaaaagttttataggatgtttaaagaagatatttggattggttataactcaagaatgtatgatcaatatattctcaaaggaatcttattggggatgaatcctcactttatcagtactagaatcattaaggataatgtaaaagcatttaatgttgttagagaagcatataagattcctttaaataactttgatataacaacgggctttcatagtttaaagcagcttgaaggttttatgggatcaagaatcaaggagtcatctgtaccctttgatattgacagaaagttaactgaggaagagataagggaagtaattgattattgtattcatgacgtgaaacagactattgaagtatttgacaataaaaaagaggaatttgaaagtcaattggcattaatcgaagcgtttaatttaaagatgtctatgttcacaaaaacaaaggctcaattatcagcatttatattaggagctgaaaaacaaggtaatcgaggagatgagtttaaccttttgttcccggatactttgaagattgaaaaatacaaacatattgtggattggtacaagaatcctgagaatctggattattctaaaaagcttgaggttgaagttgctggtgttcctcatatattcgcatggggtggtttacatggagcacttccaaagtacaaagacgagggaattattttatgctgcgatgtagcatctctgtatccttcaataatgattgaatatggttatataagtcgtaatgtaacaaatccattaaagtatacggagattagagatactcgtttagatctaaaaagaaaaaaagatcctaaacaagctccttataagatcgttttaaattcaacttatggagctatgaaagatcagtataatcctttgtatgaccctttaatggctaataatgtgtgtttagcagggcagttattgttgttagatttaattgaaaaaattgagccatattgtaagttgattcagtcaaatacagatggtttgtttatgaaagtcgagaaagaatctgatattgatttgattaaggatattgctaaagagtgggaatcaagaactcggttagacctggagtgggatgtttatgaaaagatttatcaaaaggacgtaaacaattacattattattgataaagatcaaaagtataaatccaagggggcatatgtaaagaaacttaataacctggattatgacctgcctattgttaacaaagcaatgattgagtactttacaaaagcaattccagttgaggaaaccatcaatggatgtaatgaacttagagaattccagaagatttctaaggtttcaaacaagtacatgtatgctctccatggggaagataagttacctgaaagagtattgagggtatttgcttctaaagaagaggatgccaaaggtgtatttaaagtgaaaacagaagatcgtattgagaagattggtaatactccacctcgctgctttattaataatgataatattaaaaatgaaaaggttcctgattatcttgataaagaatattatattgaaatggccaaaaaacgtatcaatgattaccttggcatatcgaacagaaagaaaaaagcaaagaaagagaagtgatacgcatcaacattaagaataaaaataaaattatatcatatacatcgaaaactaaatatgctatgatgattttaatcccattggttaccttttcatacataagtgctgagcaacattatttagatacaggaaacaataaaaactcaataaaagaatcattttatggaaaaccaaaactaatcaacataccacaacacaagaatctggtgctaaataagtttgctgaaattgttaaaaagcagaaaactaaacaggaaaagcggcgagaagatattcttaacgcaggtattattaaacccaaaccagtgaaaaagaaaagcatcaagaagggaggtgagggtaagaacaagaataaacaaataaagaataaaaataaaattacatatgaggaaaatgatgatgctaggacactagatatcgaatttagcgcatatgttgctaactgtaccgaaggctgcaccggtcgaaccaaaactggcgtagatgtaacacaatcaattttttacaaaggttatagagtaatagctacagatccaagtattattccacttaactccgtagtattaataaaagtaggagggagttcatttaaggccatagccattgatacaggtggagcgattgttggcaataaagtggacttgctggtatcaaatgaacaggatgcaattaacttcggaagacaacatggaacggtttcaattattaattagggggtattaaattgcctaaatactggagttatcctgttggactagctgtagaaattaacaataatgcacgatatggctgtcctcatcatgttggaagaaaaggaaagattattgagcatttgcattcagctacatatgactatgcagttagcgatgaaacaggtgacattacttactttaaagaacatgaattaacaccactaaagggaggtttaacttatgtttaaaaaaggtcaaaaggtaattgttgattttacagatgagataggagctgttgcgaaagttgattatcgatacaaccaggtagaagtaaagtaccctgatggtacttaccaggttgttggatttcataaagtaagaaaggtggggaattaatgacattaattatcttggaggggcctgattgctgctttaaatcaacagttgcagcaaagctaagcaaagaactgaaatatccaattatcaaaggttcaagctttgagttggccacaagtggaaatgagaagttatttgagcacttcaacaaattagctgacgaagacaacgtgattattgacaggtttgtttattctaacttggtatatgcaaagaaatttaaagattactcgatccttacagagcaacagcttcgatttattgaagataaaattaaagcaaaggcgaaggtagtgtacttacatgctgatcaaagcattattaaggaacggttaaacgtacggggagatgagtatatagaaggaaaagacattgattcaattttagagttgtatagagaagttatgagcaatgcgggattacatacatattcatgggatactggacaatggggcagcgatgagattgttgaagatttaatccaattgtatgagtaaaacaaaataaaaaaagagtggatagccaccctctcttaaattatctagtaacagttacataatgtacccaaataataacgccatttttataaacaacgacagttgctttaccagggcctattgcatttaccataccatattggttcactgttaagacgccttgaccattaagaacttggtactcgtctccccacataaacacattggaatcaccaacacgcatatcagtgtaggtctgaccatatgtagctgcagaggcttttggggtagcaagaggtgaagcaatgaatgctccaaaaactaatgataatgctagtaaacttttaattgctgttttcatggatcatgtcctccttatatataagatcaggataattataccatagaataatatagtaaacattataaaatgtgacaatttaaccaatgagatattcaaacagctaatgcgagagtatccttatggttgaagacaaaattaaatttcaaaactcaataagatatctctattatcgagttaagtttgaattttatggatgtttattgtgcataaaaaaaacgcctatataggcgctttaaaacaaacttacaaaccaacagctttaattgctacacttctattagaagagtcatcagtataaagctctattacataatcattgctgttgaacattggcttttcaagatatattgttttttcatcattaccagcaactgtacctgatttaatttcagtactgccttttgttacaatgtaatttaccgactttgaactataatttgtaaaaagcaccttagttgaatcaaaattaccagcaaattttgctgaagcagaccctttataccaactaggaacactgttgtataactctgttctctgaatgctaaatggtgcatcttcacttactttgttttcatttactgttgctgcacttgcaccagtaaatgatgcacttaccatagttaatgctaaaagactagtggctaaaatctttcttttcatatttaccgtctcccttgtaaaaatatgtattgcaaattcagtatagaaccgaaggataaaaatgtaaatgagtagaaatatctgtaaaatatgctttggaactatataaaagatcaattttattggaaaggaagagcaatataaatattaaagacttagagtctaaatacataaacaaaaatttaactatcgaagaggcgaaactgtttttaatatatctcgaaaagaacctccatctagaatttgcagagcggcgtataaagaatttgaaaagaaccattgcatctagtgagggattaattaatgcgaataaagagcgtgatgggcataatttagagatcgcaaaactttatgttgatttaacgaaaaagtgggaaagtcatggcgcatattttgtgcaaagacatgctatgactaaatggtacctcgatagtgagtgcttttatacatggtttagtgggggacatgtcttagatgaattcccaaaagcgtaaaaaacagatgaaaaatttgagtctttattgaggagaagagttgtgttatctaaataaaatttgtcttttatttagaataaaaataatgttactggagtgttggggtattaacaacgagcaaataattgagaggtttaaacaaagtgtcaaagattatagaaagaaaatcattaatggggaaactgaccaagcgcagcgttatgtagttgcattagaagctgaaattgaagcaacagcaaatttcatggaagtcctcaaaactggaaaggaaacgattgaggatgagatactacgacaaaaaggggagtgaatatgctaactgatcaagaaaaaattgatttggtaaacgctcttgattttatagttattgaaccacatacacaaagcatttacgtacataacaatgaaaagaccaatggagtattagctaaggttttgcacactatttcagtagatgagtatattgagagctttaagaaagggagtctaattgatatctttccagcagcaatgcaagaagccggtgcggaaggatttaaagatgggcagtttgtgattatgccaaagaaattttatgttgatcaatgttatgcgatgagtaaggaaatcgagcggttaactaacctaatcgatctaaacaatattaaaccaaatacatatcgaggcttgattcattaaattgtttcaagaaaaaacgaaaggataaagggatgtttattgaaaaagtattatgtaaggtgtaaagacagcaaaggtgaaaatgcgtctctagttattgaggcgctatcacctgagcatgcaaaagaacaagcatacgaagtaaatgaggtaaggaatatttataatgtaagtccgggagaaggaacatcaaggaattatcttgaacgtaaatattctccatacataaaaaatgacaacggcaaggctataactatcttttcataagggaggaagaccatttgaatatttctgattcaataaaagaaactgtaatacaatctttggatcaattagaaagtaaaattaatgaactatttatttacatggaaaatgacctacctcctatcacagaaaaacaatgggggattatagacaaaaaattcagtgaggtgtttgttaaatcaattgaattgagagatatattaggttatttataatttaagttcgaataatcattacggttggttattactgattttacttgttctaaaccgccccattcggtaagcaactgctcacctttattatttatttcatctaagttaggaatgtaaccattccccttacctgactttgagaataccagataaaatatattctttttttctgttccaccttttctcggatccggatttattcctaaattctcagctaaagcaattgagccttcgccaattttattccttgggccaatatcagcaaaaattgcataagataatttattatttaataaattaattgcaacaccatagtcaccaagctgtgcccctgttgggttatttggtggtagaacaaaataaggaatttcctctgaatttacgtaagccttaggattcgttctttcttttgacgcatctacaagtgcagttggtgaaatataataaccaggagcaggatctgtttgcttttgaataagtggccttccattaggtttaccgttgtgagttaatattccataccaattaccaggtcgcccagcattttttaaatcatctagtcctttgttctgaggatgataagctctaggggaaccatcagcgtcaacagccattttactaacaaagaaaaaaccatttttatttggcagcttccatataggcacattatctccatggatataacctatttgtactttttgtctataaccctcattcctagtaacagaatttacgtaataaggataagggcagctatagtatggtacataaaaaaaatgtggaataaagcacaaagtttgatttcttaaatgtatatcgggaatgtatacatacaattaatttctcctccttttttaagtaagatatgataataacctaaaaaatgttaattataaagttgatggaaatcattaagagtaaaaataaaattactgttgactgatgctatgaataagagtatgctagtcttataagaggagaggtgatactttggagtgtactaaatgtaaggaacatattagtggagtcgtcttttacatgaggattactgatgacaaagaatataaagagtttccgctacataaagaatgcggtgaagaattgcacaaaacatgtttggaacattgtaaggtcatgaaattagaaaagacacttaaatttttgaaattaaaattagaattaaaataaaatcactataaaatattccttttatcgaaaatggagagatgatgagtgaatcaagaaaaatgggtaatcgtagtgagacgtgatggagatcaaaacaatgaaaaagtatataacaattttgttactggagaagatttgattttcacaaacctggaagaagcagaaaaattcgcaatgagaattaaaacagaaggtagagggttatggacattggttgaaccgtacagtaagcatgtattaactgaaaaagcttttgataacaattttgtcgctacaatgaaagctaatcgtgaatctactcatgaataagtgagtaaagagagggaggtattttaatgacaaatacatggttcatcagtgatccgcactttggccataagaatatcatcaaatatgatggtgataaacgaccatttaaagatactgaacatatggacaatgtgattattgagaatttcaataaaacggttagcgaaggggatacagtcttttggcttggagatatgtttttctgtaattcaaaaagaattgagtacatagtgagtcggttaaagaaaactagaaacatacttattagaggaaatcatgacaaaggaatttcagatacaaagtttagaagacttggttttgatccacataggatgtatctctatgaggattacatccttactcatgaaccaatttctcaggtgaatatgaacagattaattgaggaatttcaactttgctgtaatgtacatgggcatacagacagtgaggaaactggtctcgaaaagctaagtcatgtttgtgtaagtgttgaaaataccgactttaaaccagttacgatggattggattaactcgaaaaggtgggaaggcgtaagaaattcgtattggaaatagaaaataatttcccgggcaagcgcagtatacgacaaatcaaaacaaataacgaggagagattaatatggacaaagaaaagtgggtagttgaggtctatgcaggaaaagaattcgctggaaagatgactggcgtagatggaaaagtagcagtatttgatcaacgagaacaagcaattaatgaggcacaaaagtttaaagcaaaaggtacgttgggcatctggtgtaaagtcgttcagcatgtggaggagcaagttgcagctagtcattaacgttcttgaaatcgtaggtcttttgttgattggaatagtatcactagatatatatggaactaaaaagggaataaaacctcaaatcgctttagtattgttagttctagctgttctagctgggttgtcattcttaatcagtttagttttattaattatcaatattatctaaataaaattcaatttttaaagagacttataaggaggtgaataagtgggacgccataaagcaaagattgaaggattggttatgaaagaaagttattactcacaccgtaccccaggtacagagaggtggattactcagccagtgtgtaaggtaactcaaactgagccaatcttcgagggttatatagatattgagcctatagaagttggaggtaaagtttatatccctggacttaatgaatatgtcatagtgactgacaggcagcgaaacatacataacgagtgtacatatcaaactgacagagtgattaagacaattgtagatgaaaaaagcttgaaggaatgcgcagaacacaataataagaaagcaaaaaacaatgatactcaaaatcaaagacagataaaaacttcctggtggaagaggctaactaaaaaagaataaaggagagatatttattgaataaggatacaaaagatatttggagcggattctttatggggtcaggttcgttaattgtagttgggttacttatttttgttgaagcgttgactatgtcactaattgtttattacggattgaatcatgtgttaaatcctttgcttattgatacatacaatattcaaaatgtccatgtcattttacctcatgcatttgttattggtgttttactcaatgtatttgtcaaaggtgtaaaacggtcagatcaggaaaaagatgagaacattttcaagaaagccggtaagtctttacttcattcagctttcgcattgattgttctgtatgttagcacattgtttatctaaggaggcactcaagatgagtgatgataatgctgcaaagattattttcaaaaagaaatcaactggtgaaatagtcggcgaaatgaaagttacacctttacctgctgacacctttttgcaaaacgacaataagtctaaataaaagttttattttaaagatatttgacagggggaaataaaagtgcaaattgaacagttgaaattttataatatgggattgtacaagtggctaccgtgtgagccagatgaatgtttagtgctaaatgatatttttgtaaccgaaatggatgaaaaattagttattcatctaaccaatagtcaattgaaaaagcttcaaaaaggatttaaaagttccttcccattatttttatctatttaccaacataaagaattcctttacctcgctttaaaagtaacaaatgttgaatttgaaaattctcaatccccaataacaaaggttgtacttactgttcaatatttaactgaggatgaaaataaagaaattggataaaaggatgattttaaagagattagtggattctaaatctaaaaaataaattaagaggatgatgaagatgaaaatgaaatatggactttattgtataggatcacttgttaatacttatgatgatgcaattgaggctcataatgatgctgtatatgctcaagaagaaagcggggtaccgcatgaagtaagagaaattcaataaaaataagaggaggatattatatgattcaaggattttataaagatcagaagcttcaccttttagaagatcctatgcagcaatacactgtcatgaaagtagaaaaaaatgctgtatgtgtttaccggtggatcgatgattatagacacaagattgagagattcacagatgttgaaggggctaaaaagcttcttggcgaaggatggccaaacaaaaaatcttgataaaatcacagctttattcaaaataaaaacaaataataaggagatgtaaaatgggggcagctagacagctatacgtaaagcgtaatgatctggtgactatggaagaagcaaaagaaaataagaagatacatatgcaaaatggtgagtcatttacagtatttaagggagaacttattgcaactgacttagaaggacaccaaatggttattcctcaaagccaaaaggataactatatccctgttgaattagaggagttgtctccatatgaggctcaaatggccaaaggttatgctgagatgggagctattaatagtgaaatagctgaagcatattaccatgttgaaaatgaagctgaatctgcaactacaagattaattacaggagcatataacgattagtgatcattacatatgagagtaaaactggcaatgtaagaaggtttgtaaaagcgttgtcacaagagttagacattgaggcaattgaaataactgatgatacgatcatcactcaagagttcatacatattacatatacgataggctttggggaagtacctgaaagaactttgaattttatcaaaaagaataaaaataaaattagaggagttgttgttagtggtaacaaggtttggggtgataactatggtttagctggagacaagctttcggctaagttccacattccattgttattaaagtttgaacttagtggaacgaaacaagacttacagaagctcattcaggaggtacaacttattgacaaacacaataccaaagtggatcaagctcaataatgagatcatgattcagaaagatgggaagtatcaattcgaaaaggataaggaggccgtacatagttactttgttgattacataaatcaaaacacagtctttttccatgatttaaaagagaagctggattatctgattaaaaatgattattacgaagaagaattcttagatcaatacacatttgaacagattaaatcaatttataagattgcttacagttacaaatttagattcccatctttcatgagcgcgtttaagttctacaatgactacgcattgaagacaaacgataaaacaaagatcctggaaaggtatgaggatcgtgtctcaattgtggctttatattgcgctgatggcgattatgagaaagctgttgaggaagtacatactatgatgaaacaagagtatcagccggcaacacctactttcctaaatgctggacgtaagcgaagaggtgaaatggtgagctgcttcttacttgaagtaggcgacagtttgaatgatatttcacgtgctattgatatctccatgcagctttctaagctaggtggaggagtagcattaaatctaaacaaactaagagccaaaggtgaagcgattaaagacgtagataatgcgactaaaggtgtcgtaggtgttatgaagctattggataatgcttttagatatgcagatcagatgggacaaagacaaggatcaggagcagtttatctaagtgtattccatccagacataacagacttcctggataccaaaaaaataagtgctgatgaagatgtccgagttaaaacactatctattggcgtagttgttccagataaatttattgaacttgcaagggaagacaaggattattacatgttctatcctcattcagtctacaaagaatatgaacagtatcttgatgagatggacatcaataaaatgtatgatgagcttgtcgaaaaccctaggattagaaaatcaaagggaaatgctcgaaagctgttagagcaattggccattctaagaagcgaatctggttatccatatatcatgtttgctgacaatgtaaataaagtgcatgcaaatgaacatatttcaaaagtgaagttttctaatttgtgcgttactggagaaacacttcttttaacagagaatggatatgaaaaagcagctgatctttacaaaaagcagaatgatcttaaagtggtcattgataatagaacaaaagattttgcagttggtagcaaaggtacttcaattgtagatgcaattccaatgcaactgactaaaaaagatgcggaaatatttaaagtcaaaacgaaacaaggatatgaaattagggtaactgagtggcacaaattctatgtgaaaagagatggtgaaattcaaaagctccaattgaatcaactggaaacgggcgataaattattagtccaatcagctgaaggagcatacggtgacattcatgagccagatcttgcttacatcatggggattatcgctggtgatggaaccattaccgataaaactgccaagatttatttatatgacaataaaaaagttcttgagcagaaagttactgaagccgtacatcgggttattcaaaaacacaaactcgatcgtgtatataaacacaatacatcactggttccaacatttaatatggccaatccagataaacaagatttgctctacatgaatagcactgtcttatttgatatcttgaagaagttcggtatgaacaaaggaacaaaaacaagagtcccagaattcatttttcaagctaataaggaaacacaagcagcttatttatcgggtttattccagactgatgggtgcgtaaatgcaaatcataaagccaaagcattaactattgagttaacatccattcactatgagagccttcaggacgttcagaagctattactgaacatgggtatttatacaacgatctattctaacaacaagcgttcacaagaactccttcctgatgggaaaggcggttctaagctctacaatgtaaagccaacacacaaactcagtattcaagatagaaactcaagagagttgtttatgagtgttgttgaaatgaaagaatacgatatttataaattcaatttgctaactgtaacattgcaacctaagtcaagaaagccaaagcatgattttacagctgaaattatcagcattaaagaagatggtgttgaggatgtttatgatacaacacaggaagactatcactccttgattttcaatgggattgttactggcaactgttcagaggtactccaagcatcacaagtgtcagtctatacagattacgatcaggaagatgaaattggattagatatttcatgtaatcttggatccatgaacattgtaaacgtaatgagtaatcaatcaattgcttcaacggtcagaatagcaattgactcattgacaactgtcacaaggaaaacaaacattgtaaatgctccagcagttgcgagagcaaatacactaatgagatcaattggtctagggcagatgaacctccatggatttctagctcaaaataatattgcttatgaaagtgaagaagctaaggattttgcaaatacatactttatgatggtgaatttctactctctgcagcgttcaatggaaattgcacgagaaacaggggagacatactacaagtttgaaggttcgacttataaatcaggtaagtatttcgaaaagtacgtaacaaatgattatagccctcagtatgaaaaggttaaaaggctatttggagatcaacatattcctaatactgaagattggatgaagcttaaagaagatgtaatgaaatatggtctgtatcattcatatagacttgctattgcacctacaggaagtatctcatatgttcaatcatctacggccggtgtaatgcctattatggagagaattgaggaacgtacatacggaaacagtaagacatattatccgatgccaggtttatcggctcagaattggttcttctataaggaagcatacgacatggatatgtttaaggtagttgatcttattgcaacaattcagcagcacgttgaccaaggaatttcatttacgttgttcttaaaggatacgatgacaacgagagacctgaatagaatagatctctacgctcaccatcgaggaattaaaactctctactatgctagaacaaaagatacaggccaggaaggttgcttgtcatgtgtagtttaggagaaaacggaaggagcatcacaatcttcaattaggagctaacaattggtgtgtgaaggatataaacgagctaaacattaggaagtttaagtggaatataagcaagccggcaattttaccgacttgctttggggattactgggctacaactttacagctttaaagaaaccatcgacgctttccccagttccactatcgtagttgaatatatattctccctgttgtttaacagtatattctttgatgaaggtttttcctggttttaacacctcatctgattgaaggacatttccattcggataataaatggaaaattcgaaggatttatttccgtcatttgcaacaaaaatacggattttgcttttagtgccaccttcataagtaaaagtaatatcacctttttcttcagaaaaagggccacactttaaaaacgtgccttcacatgcccaactagattttatgggcggtgattgatctttaagtggttttgcagatacgtctgtaactcccataaaaggtattagacctaaagctaaagcaccagcaataaatttctttttcattttttattcctcccttaatagtgaatatgttgcattataaaacttacaacatttataaaatatttccttctttttacaagttttgagggaggaaaaatattaaggaggtcacatttttgtcacaactaaacaataacaagctgtataccgcagcaaactggtcaaagcatgaagacgattttacccaaatgttctataaccaaaacgtgaaacagttctggcttccggaagagattgctttaaacggcgatctcctcacatggaagtacctcggaaaaaatgagcgggacacttatatgaaagtcttagctgggttgacgttgttggatacagaacaaggcaacactggcatgcctataattgctgaacatgtagatggacatcaaagaaaggcagttttaaatttcatggccatgatggaaaatgctgttcatgcaaagtcttacagcaacatctttctaacattggctccaaccgagcagatcaatgaagtctttgaatgggtgaaaaacaataggtttcttcaaaagaaagctagaacaattgtttcagtctataaatcaatcaagaaaaacgatgaaatttctttatttaaaggaatggttgcatctgtgttcctggagagttttcttttctactcaggattttattatccactttacttttacggacaagggaagctcatgcaaagtggtgaaattgtaaatttaattatccgtgacgaggcgatacacggcgtttacatcggtctattagcacaggagatatataagaaccaaacaccacagaagcaaacggaattgtatgaatgggcattaaacttactgcaggagctttacgaaaatgaattagagtatacagaagatgtctatgatcaagttggcttagctccagatgttaagaaattcatcagatacaatgctaataaagctttaaacaacctgggattcgatcatctgtttgaggaagaagatgttaacccaattgttattaatggattgagcactaagaccaaatcccatgacttcttttcaactaaagggaatggatacaaaaaagcaacagtggagcctttaaaggattcagatttcatttttaccgagaaaggatgtattcaatgagattaattaaattagagcagcctaattgcaatccatgtaaaatggtgtccaattacttagaacaagtaaatattcaatttgagactgttgacgttacacaggaaccagaagtagcagcaagatttggtgtcatgggagtaccggtaaccattctgctgagtgatcagggagaagaagtaaaccgaagtgttggttttaagcctaatgaacttgatgagttactaaaggaattacgataaaagggtaattttaatcaaatttaaattaaaaggagctaataaatgtatttcattgaaactcaagaaggattaattggtaaagaagttgcttatgtatgggcaaatcagttttgtgagcaaacaacaattattactaaggatgggggcgtgtttatgacttgtcaacaagctggttgggatgatgactatgagacaagaattttatacgcttatgaagcaaagaagatcttacaccctctgaaaagagaattacatgaaaaaggtgtgatcgatgaaacagagtgggaagagtatgagaatgagttgaaaaagaagcaagaggcaaaaagggaaaagtatctcaaagagaaagaagaacatgatcgtaaactatatgaagagttgagggcaaagttcgaacaataatgaacagtttgtttaactgaagaatgcaatacaagaacttacataccaaaaacaaaaggggctattacataatgcaaattaaaatcaagtatctagatgaaacacaaacaagaatcagcaaaatcgaacagggagattggattgatcttcgtgcagctgaagatgtagcgatcaaaaaaggtgaatttaaacttgtccctttaggtgtggccatggaattgtctgaaggttatgaagcccatgtcgttcctcgttcaagcacatataagaactttggtgttattcaaacaaactcaatgggtgttatcgatgagtcatacaggggagacaacgatttttggttctttcctgcttatgcattacgtgatacagagattaaaaagggagatcggatttgtcaatttagaattatgaagaaaatgccggcagttgaattggtagaggttgagcatttagggaatgaagatcgtggcggacacggttcaacggggacgaagtaagtaaaattaaaaaccttggctgtattcatgctgtgatctgaacaatggaggtttccagccaaggtacatattatcatatgagagaatgcataaattattcaatgtttattgatgaagagttctttttaatacgacaattcaattttccaaaaagcgtccttaagatgtaaaagaaccaataccctattaaagtacctagagtgttaagaattaaatcatctacatcaaaacttctgtaaattgttcctatatacactgaaaacgaaagctgtattaattcaataaacaaagatatgaaaaatccagttagcaaaatcctttttacatttgacttattaaataaaagaggaaacaacaagccaactggcattaataatattaggtttcctccaattgatctaattacatagtattgaagaccttcatgataaatgtctacaaaaaaataaaacgggataaagttatttcctgatacaaaagggatataagtgtcatccctcatatccttaattaaaacagtatctattggaatagggaataatgtaacacttatcaagttgaaaaagtaaaccaataaacaaaagataacaatatgtttatgtatgggtagacggccttttttgtaaaggactcgtcttatgagtctgtaaaatataaagcaaaaataaagaaccattaagtatggcaagagaaaagctgagtcgagcataaatacaccacaatttcctttttaactcattttaacataaatagggaaaaggagagattctgatttcaataaaagaatacttttatctaatatttaaggaggaaagagatcattaacagcaaagaaagagctttacaagcaaaatatgacgacatgctttataggaatggtctttgctttggatttcttcagttgcaaggacttgaagatgaatttattgaacatatgagacaagttgctgagtacgagaaagacttgagatacaagaaggcagcagctaacttcattaagatacatgaccaaaataaactgggtgggttattaattgttaaaggataaaaataaaataacaaagagtattgaaaagatcaacaaacttgaagaagggttgtcactatttgaagaaggtgacgaagaatatttaagtgtattagtgaaaattcaggggctatatgatgaaatctcagatactgctttagagtgttttaaagagatgactacaaaaatcaggaaaactggtcagaaacgagttggaaaagggatcgatcagttgccacatacaattagagaaagtgtcaatgatcaaatagatgaagttaaaggggaacctcactaaagaggagttcggcttctcctctttagtgttgaagattgtcaccatttaataattaagtcactgacttttttccttccaggatgaaaataatatccttcgtcagaaagttgtcttccttgccaatttagacttcctgtgctaataccatttgacattaactctgtttggagattatctatgtattgattataaactttttgaggaaatccattgggattttctccccatgcagctataacgttatttgattctctagaaattcgcacaactgtctctaggtttttctcggtaataatattatagtttactggttcagacgcttttacatgagtaagcaaactaaataaatttttagaagcgggatcaaaaaaagggaaaacatttacgatgtatattgttcctattccaaagcaatcttttttagcatgaataagatctgaaataatattaactgtttggtcagactctttttctgaagcatgactcgggtttttacaaataaaagtgcatactttatcgttgttattatcaagttttatttttaaaaagtatctaattttcttgccagaaatgctatcgaattcataaccagttatagtttcattatgtttgtaatttatcattttcctatacacaacctcatttcactgcgttttaataataggaggatttaaaacatgacacaatttgataaacaatataactcaattataaatgatattataaataatggaatctccgatgaagaatttcatgtaagaaccaagtgggattctgatggaacaccggctcacacactaagcgtcattagtaagcaaatgatattcgacaactcagaggttccgattttaacgacaaaaaaggttgcctggaaaacagcgattaaagagctgctctggatttggcagctaaaatctaacgatgttactgaattaaacaagatgggcgtacatatttgggatcagtggaaacaagaagacggcaccattggacatgcgtatggatttcagttgggcaagaaaaacagaaatctaaatggagaaaaagttgatcaggttgattatcttcttcatcaattgaagaacaacccatcttcacgcaggcacattacaatgctgtggaatcctgatgaattagattcaatggccttaacaccatgtgtatacgagacacagtggtacgtaaaacaagggaaactcaatctggaggtaagagcacggagcaatgatatggcgttgggaaatccattcaatgtatttcagtataatgtgttgcagcgcatgattgctcaagtcacaggttatgagcttggtgaatatatctttaacattggggattgccatgtgtacacacgtcatacagacaatttgaaaattcaaatcgaaagagaacagtttgaagcacctgaattatggatcaatcccgaagtcaaagacttttatgattttaccattgatgatttcaagttaatcaactataaacatggggacaggctttcatttgaggtagcagtttaatgctgcctctttattgctaattttaacaaaaaataataaggttggagtatgaggaggtgttgtatatgctaactgaagatgagctaaaatggataagagaggtactcagggattatgagtttggcgaaatttcaccttcatatttttataaaaagaatacagaaattgaacgcaatcgcaacagaggaatagtccgaaaaaagttggatactcttaggaataaaatgagaaagtataccccggatgagttgctctcgtttaggaaaattagtgacagagatattcatgactatgaaaatttttcggggatttatattatccacaattgcaacttggatgagtattacatcggacaagcagtaaaggtagttgatcgagctcgtatgcattttcttgccaatgcaggaaatgaagaggtatataaagacttttccttaggggatacatttagcattagttttattcctttaaacatcacttcatattcaacgctaaatgaattagaagacaatgctataagagcttatgattcattccataatggatataataagatgcctggaaatgtaatggacaaatatattttcaaaaatgatgattatgagaaagctgctaacttgatattagacaagatcaaaggaacagagttgttcgctagccttaccaatgaccgaaaaagaatgaaatatactcgaagcttatttaccgaacttgaactaccagagaatatacattttaggttgggtttggttaagtgcataaaagcttatcaaaagcctaataaagctaatattagaaataaagaataaaataaaaattacctagacatatatattttcaggtgataagatagatacaagttaaacagcttgtctttagataaatttagaataaaaataaaaatactataaaactaatattttattcagaaaacaaaaaagagaggggagccctctcagattattaagtattgtagtcccagtaaacatccacattaactgttacaccagcgttgctatcgttattttttgcttccacgtaaagtgatttacctgacacatcagacaggttaacgctaaacactttgtagaactggctacttatatagttgccaccacttggtgtgactcgagcaacttcagttccattggatttgcgtaagatgtaagtgacgttagcagaactgtttccgtttcctgctgagtattgataacccataattgatatttttgtaacattgttaggagtaaatgaatttacaacagttttatacgacaagcttcctgatttagatgatcctaaataagcttttcctatcccatttttaactgctgtagctgaacctaacgcatggaagctaccagtacttgctgatgccactagattattttgaggtaaggcagttggctcacttttagtagctgcatcggctgaggcagctgcaccagtaaggccgagagttgaaactaataaagcaattgctgttttcttcaccaaaaacatctccctttattagaaaattatgatacttctttattatagcagttaatcttgaaaaaaatggtgaatgttgtgaaattatggtgaagtttctgaacagagtgtaaatttctctttttaaacttttaaggaggtgatttattgataaaggaaaatggaatacatagcaccaacgaacaaatatcagccttagagcaaaagaaatatcatatcgaaactaagttacttgaaaaacagagggatcttttaagacttgaaactcagcaaaacaaagagaagcttgaatttttattcgagctaagcgaagtcttaacccaattgcaagatgaagaatgggtaagctgcatgattgctttacaaattattagaagaaataaaagaaagtatttagatctgtttgatctaaatgatgataaagcatacgtaaataaggataaatttaaagttcttcatgatgaattctttgaattgaagctacaattaaatgagatatgaggagttgtcagttgacggtagcgaaattggaggtgacaaatatatgtgtacatgtgaagagggtagtggcaaatgtccttattgtgacggagcgctggatatattctaaatgaaatctgtattttataaaaaaactggtcattagaccagttaaacatatttatacctactcattaaagttaagttgaaaatttgttcagatgaaaaccccatgctcatggctctgtgcatgtcttcagtttcgcaatgaagtgaatagaaaagctgatcaaccttatcaaaaaacatcttgtcgagataattttcatcaaataaataagcaacaattgcatccgatttttcaatttctgtttttgcttttaatcgtttgtttccgtcaacacataacagaggggttggcgtaccataaaatctaacaaggaaaggcaatctgttatcgttaacttttgatgcaataagtggtgcagaggaattgaaatgaactgaatccaaactgaagttgtgtctttctacgtttgcatgtgtaataagatatttcattttttctatatcaaatttataaatatagctacctacaggtgaattaaatttaaaatcaaacatctcgtgagtttcttcagagctttttagaggattgatgactttgtctatgtttgacttaagaagctcgtcttcttttatgagagtatctatccaaaaatttttccaatccttaaagaaggggagtgaacctaaagcatgcttgaaaatgtcttggttcaaatatttatcaaatgggaatgaatagtattcacttggtgaagtagctgtaaaacaaatcggcaaaataaaacctccaaccttttttactcaattataccagtaaatgaggttgaatgaaatatatacaatttatgagggaaataatcccctcataaattaatgaaattgaccgcccatgttttgttgagctaagcgaactaaacgtttagtgatttctccaccaactgaaccgtttgcacgagatgtagtctcagcacctaattgaacaccaaactcagaagctatttcaagtttcatttgttcaatagctgaagctgcttgaggaattagtaaatcattattgttgtttgatcttgatctactttgttgagccatcttattcatctcctaaagtgtaatgaaaacaagcttgtttgaatcatattatggagagattattttaatttatacacgccagagaaataaatttttcattaagaaaggtggggacaaaatgaaaattgattatgtatcagatctccatataaatcattggataccttggaatgtaaatcagattaagtgggagaagcgaacaagagaaattgtaaataggttaatctcaaacggtaatggggaggtattggtcattgccggcgattttactgaatggaatcaacaaactttatgggttttagatgaggcagcaaagcaatacgagaaggtttactttacatatggtaatcatgatctttatttacttagcaagagccaaaaaaggaaatactcagactcgttagggaggttgaatgatctaattcaaaaagctgctgatatgaaaaatgtaacaccattaattaagacaactgaaacatacaaaggaaaagtctttgcaggagatgtaatgtggtaccttccaaaaggaatcgaaggatgggacttctttaaaggagtatctaacgattctaattacatttggcttaatggttataacaaagtagatggtgtaagagcgatgtggaaagaatcaatggattggtatgaaacgcttgaaaatacacaagttgatgtatttgtctcacatgttccacctgttcacaatccttattctccatttgagcctaatacatgctacatggttgatgtcccattcattaacgcaaaacactgggtttgtggacatgatcatttacaagctgagtttgacaaagatggaacgagctttcacatgaattgtatcggatacccgtatgactatgataattatccgagtgtcaatgtgatacctggtgaagaagtagattcatataaaacgtttgagcttaaaacattcgagatttagatttaattaaaattctaattttatgtagaggtgatgtgtatggatgaaataatgatattgaatatggtaatagagcgcttaaacaaagctaaaaaaattgccaatacttatgatgaagagtttggaattgacattgcaatagacgaagttgaagaaatgattaatgaatttaaataaaatgttgattttattagtatagaaagaacttgaatggcggtggagaaatggagtgccagcacgaatatgaagtttgttgttataattcgtcagttgtgattgaagaatgtgcgaaatgcggcgatgaaaaggaaacagactttgacagttattgtctagattatggattccctgtccttccagatgaagttgattaaaaattaggaggagagcatgacgaaagtttataaagctgagttttatatcactgaagttgaacgactaagaaggataaccagcaatggataaatgctttgagtggtggggagttactatgactggaaatcagaaaaccgtaaaagctttgagtgagctcatggacatcaacaaaacactgttcgagaacctctacaaagtacaaacagatacaattgaagagctcgtaaacaaactatatgaacaggttcctggctatgagaagaagttcttaaagtatgtcaatgagcatttacctattctgaagaggtgcttacagttcgagctaccttataatccgcaactaatatccagcataaaatatgaaatctacatatccagtgctgaaattgattgcgaatacccctttgacgctagaggttgcataattactttctttcaacgagtgccagaaataatcgatttgtacaaggagggattaagtgcattacaaattaacatggtttgatttatattatagaactgattcagagtctaaaattagttgttgtttactgcgagtgtttgaccttatgaaagagagcctgcacatatacttcaatataaagaattctaaagatatttatgattttttgtcccaggctaaaagacaaagcaaggataacctttttgttgaatggtttataaataaaggaattcctaaattaaagagtattaactttaataacttgccaaaagatgaccgtttccttgcaatgttggaacttgatgagtatatcttaaaaagcgaaatggactttgcagatccagaggaaataagaagctgcataatttcatttgtgagcagtcttcaacaatacattgacctatgtaaggaggagttaaatgaagaatacagagtttaagaaaacaagttttttagaggaatataaacgaggggacgagatgcgaagagatttcatcattcatgaaggctatactgctatcgaagagatcattaaagaagttaatcaaaggggatctctaaatgaagcagatatttattacggaacacctaaacctcaactaagtttctcggacgttgaattaggttacatgcttacttcaatgatggaatatgcgacaaatcatgtaggaaatccagttgatgaggaatgtgaatttgaaaataagctggcttattttgagtataaggacgagattgttcaaatttttgaagtgtatggccaaggtactgaaagctggttttctaaaccaagtgacgataccatcgataaattgaataacacagcttatggagtgtatttgatccagttcgatgattttattaattacactaaaaataaagatagcgagagtgaaaagctgtccccaagcagcacgatcttaaatgacattaccggcggatatacagttggaagaggatctaagtagatgattgtaacagcatggattttattaattatgtttggtttatttgctttatcagatttgaacttaactgaagatgaaacaaagcatatcaaattcttcatgttaatgaaatttttttctgtttttatagctgctatagctgcaggagtaatttggggtgggttgtttcaatgaagacgattaaactatatgaacttgtatcaggaggtaaaaaaccaattattaaatttaatgataatgtgtatgaatggattgaagaatcagtcgataccatgatgatgggaaaaataataggagcttctatagaatatgaggatagcgttagatttttaatagatttgaatccttttgaagcatacaatcgaagcgttgcgcgtcatgattggagagatgatgaagggaattgtgttttaacatggtttgacacttctttttatccgaaaaacggaattgaagctatttacttaccgattaatggaagaacagaaattgcgtttgattttacagaagaagattctttattaaatgaatatgcaaaagtccctcaagaaatttcatatgttgaatggctagaaaatgaagttaagcaattaatatctaaataaaatcggtcttttaattacaataaaaataaaattagtggaggagaaaaagattaacgaggcttatcattcaattcaaacactttataacaagatggatagacaaatgaaaacagtaaaggaggccattgaagaaaaagatttgcaaagagcgcaccgtaacttaattaacttagctgacaataatgaggaattaatgcaagaaatcaggtggatcaaaaagggaaccaccttgtaagttatttgaccaattgtctgcgctctttaaagttccatacataaagctcttcgatagagcaacctatggcatcagcaaatgtcattgctgttccgatattcatatttgatttaaaaccacttacataatcattaatacgttgcttcggtaatccagtgcgttcaacaaggtcatctattgaaacgttatattcatgcaaaagctcattgagtcttggatcaactggtttccattgttttttcactatgaacacctcttcagcaacgattttagcacatacataatttaccttcaatatagattaggagagtgattgattgggagcaaataatcaaggaaaagtttttgaagcgaatattgaaaaatctgcagcagatcagaagctgtttttttaccggattaaagatgttaacccaatgttcttgaaaaggggagctgcagtatcaaaaaacaaatatgactgttttttgcattttaatggatacttgttcccctttgaacttaagtcgacaaagaacaagtccatttccttcagcgagaagatcataaagccgcagcagattaaatatttaaaggaagcaacacaatatccaaacataatccctggttttctgtttcagtttagagagccggaaaataaagtttatttcgtacatattaatgatttccttacatataagaacatagctgaaaaacagttgaaacatacatataagaataaagtaaacaaagccagtattccgattgcgatttgtgaagaaatcggtactgaagtgcgctcgatgaaaaagaaagtgaattatacatattatttaaacaagctttgtggagaattaattaagaaagaacagtcaagagacaaaccgttacatacatataatactcctgtgaaaacgggggtacgataaatgccttatgaagaatatgaagaactgaagaagaaaacaattaaggttgttcataagaagaattattcaataaggtttatcgagcaaacaaagggtagtgatgacaaagaagcgttctataaggagatcgcacaattcttgtttgaaagggctctgagaaaatcagaatagccctttcttttttgtatatttatagtcagtatcattaaatacagctttatctgtactgatattaatgacatgctgcactcggtgtgaaagggcagcttccaccacattttgtccgccgatgagattggtctggatcgcttcaaatggatggtcctcacatgtcggaacctgtttcagcgcagccgcgtgaaagacgatatcgacgcctttcatcacctgattcacccttctgtgatcgcgtacatctccaagtacaaataatagccgcttatcctccgcatacttttggctcatgacatactgtttactgtcgtctttgctgaatacaatcacctgtttaggtgtaagcatcaaaaggcgtttgacaatttgactcccgattgaacccgttccgccagtgactaaaactgttttgttatggaaaaatggttttagttctgctgtttgctgtttaggcatggcttatcctccaactctcgtttctctaccatgcatcatatgttcaactttgtaatcgaattaatgaaagcaaccaataaaacaaaatttaggggaatgatcatgtcacaaagtgttcttttttgatagaaaatggaaaaacggacgtaactagggaaaaacaaaactaaataaacaatgtactaaatattcaacatatttttatttcgctccgcaaaagtaaatctggcaaagtcatctcaccacctctttggggaataagttgtttatgagtcagaaaccctataaaaaaaggttcattttcctcacggtaatcacctgtatatattttacaatagtagtgttagtgataaaagaggagggtaccaaatgaaggttccaaaaacaatgctgctaagcactgccgcgggtttattgcttagcctgacagcaacctcggtgtcggctcattatgtgaatgaggaacatcatttcaaagtgactgcacacacggagacagatccggtcgcatctggcgatgatgcagcagatgacccggccatttgggttcatgaaaaacacccggaaaaaagcaagttgattacaacaaataagaagtcagggctcgttgtgtatgatttagacggaaaacagcttcattcttatgagtttggcaagctcaataatgtcgatctgcgctatgattttccattgaacggcgaaaaaattgatattgctgccgcatccaaccggtccgaaggaaaaaatacaattgaagtatatgcaatagacggggataaaggaaaattgaaaagcattacagatccgaaccatcctatttccaccaatatttctgaggtttatggattcagcttgtatcacagccagaaaacaggagcattttacgcattagtgacaggcaaacaaggggaatttgagcagtatgaaattgttgatggtggaaagggttatgtaacagggaaaaaggtgcgtgaatttaagttgaattctcagaccgaaggccttgttgcggatgatgagtacggaaacctatacatagcagaggaagatgaggccatctggaaatttaacgctgagcccggcggagggtcaaaggggcaggttgttgaccgtgcgacaggagatcatttgacagctgatattgaaggactgacaatctattatgcaccaaatggcaaaggatatctcatggcttcaagtcaaggaaataacagctatgcaatgtatgaacggcaggggaaaaatcgctatgtagccaactttgagattacagatggcgagaagatagacggtactagtgacacggatggtattgatgttctcggtttcggacttggcccaaaatatccatacgggatttttgtggcgcaggacggcgaaaatatcgataacggacaagccgtcaatcaaaatttcaaaattgtatcgtgggaacaaattgcacagcatctcggcgaaatgcctgatcttcataaacaggtaaatccgaggaagctgaaagaccgttctgacggctagaatagaaagcagcttgtgcagctgcttttttctatgaataaaaaaatcgttcatagcaatgaacgatttttcaagaaagcgccagatgaatcgcttttagttttgcaggaagctcatcaaacgtaaatgcgggtacggtctctttataattggctgctgcagctttttgccgttcttcagggtggtagatatagaaagcggctttttccttaaagtcgttcatgccgtgataagaaataaaggatgaaaaaggatgtgccgcgggtaaatctgttaattgaaatgcttcgcatgcagcgatatcaaacgttcggttattaaaactggtatttttgatgcgcatagtattttggttgaaagcaaaatgatagggacgatgcgcattaattacgatgtctgccccattataataatgaacggcctgttcgggtggaacccatgtgctgacgacatcaatatgcggctgtttgagcacttttttaggcagatattttccccattccttgccgattacccgaaccgtgaatggcagatggaccgcttctttcataagctgaacccgattagggtaaggatagccgatgattaacagatttgaatgataggaatgttcggtgcccatttttttaaacagccgatggttaactggtatcggaacataatagacgttctggtagccgagctcttgatagtagagagctgcattttgttctatcgttaatatggcgtcagcaagcttaattacctgaaggctgatatccatataaaatgggtcttcggtcagccaaacatacacggggatatccttaccctttaaccaggtcagccagtcgtgaggaacgcggtctccaaccatcataagtgtgaaatccggctgaaacgcttcgatcttcatcaaagattctgcttcaggtttatctgcaatcatatactctgtatgagtgttctgaaaacattcttcagcccagcgatcaaaataactgtatattcctccgtatcccgactggatatacaagactttcatcggatgttatgaaaagaacgtaacgctttctactttgtctacatcaattaatgttgtagcttggcctgccggagtgacggaactttcctgtgttacaaatacgatcccgtgaacctgatcgaaagcaacgaaaacaaccggtccgatcatgtcacctgaatcagtcacaatgctgattgtcgtgcctggcgtaattctggcaaaaatccatcttgccggaagagaagggtctaaaagagattctgccgtaaccgtttcactttcatctactttttgatcgatggcagcatcaagcaaggctttaagattactatccatattttctcctccttctgttgcagttggaaataaagggcttaaaacggctttaattaaatccttttttaactgtgcattttcagagctcattacacacacctcctattcgatagtgaactcacgttattcatattcttccggctgttatttggtatgagtcgaacgccgtacctgatctatttttcatctatttaaggaaaatgctgattttttaatggagtggacatagcctataccataaatcgaagtcgcacatattgtgaaacagagataaggataagggagagggatgatttggatttagagaaacaagtggatcgagaagaaaaccaagatgatctgcattttattttgcttttgctgattctgctgatacgtcaatcgtcttctgaaggaaatccatctgacctcagacgccagcttgtttttgcaaaagagctgggcgtaccggtttcaaaagtcaatttgatcaacggagatacacttcaaaatgtcatcgtaaaagaagttctgactgatttggttattttccaaaacccgttaaataacacgagagctcatgtttcactctcaagtgttgtaagctggggtgctttttaaatgatgacagaggctctgcttgctgcggagccgtttttatgtttgacggtgggaggcggtatagatgggagagaaagtgtctattattttaacaagttacaacaaacccgattatttgcaaaaagcgatcgaaagcgtgatacagcaaacgcatgatctttgggagctttttatcatggatgatcattcgaatgcagaaacaactgcggtgattcacaagtatctccatgaccggcgcattcaatatcataacagtttcgtgcatcctgcagatcgattaaaaacagcccgttatgccacattaattaacagtgcgctcccatttgcagacggcgattacatttcctatcttactgacgacactgtttatcatcctgagcggctgagccgtatggtgcaagagttttcacataagcctgaagcgcaggcggtctattcaaaacaaaaagttgtacatgtaaacgaaaggggagaggaaatctcacatttctacagaaatgccaatacagtgcttgatcaggccgcttttcaagttgatcattgctcagttatgcatcgccgttcgttacttaatcgcatccatcataaatttggaggctactgggatgatgatatgaagcattggaatcatggcgacgcaattttttgggcgagactcaacaactttaccccatttctgccgataaatgaagtattagacacaacctataaaaccccagattcatttcaaaatgcatatcggtttctgcccgccgatttgattgacggctcttttgtaaaaggttcagatcaaaatgtgtatttttttgatcagggtgtaaggcatcctgttggagaaaagtggggttttttgtatctaaatcggactgtcgctgttccagacccatatttattccaatataggattggcaaaattttaaacattccgaattatattttagtaaaggaagctgaccatcctgcaatattttatatcgaagccggaaaaaaaaggcgaattgtggaccagtatgcgtttcaattttatcaatttcaaagaaaagacatagtgacaattggaaaagaagagatggagacacttccggaagggccgccgattacgtggaaacgatctgaattgatcaaaaatccgcctggccgacgcctgtttttcatcgaacgcgagccgtttttgtttctaaacggcgtctttcacccgattagtgaacaagtagcaaggaagttttttttacatcagaagccaatctccgcttctttccgaaatattcagcaatttccaattggaaagccgttttatccggtgtacgatgagattataaagaaattgaatattgcaacagagtaaaggtataggtcataaaaaggagacgttcatgacaggacattattcaaaaacggaacatcaatatatattgttaacgtctgaatcggcatcgtttgatcattacagcgtatacagagatccgcagcttccgcaaattttttctcataactttgttcagctccatgatacgtttccattggagcggttacttaactttttaccctccgtaccaaagctgcttgatgcgaattatctccatttaaaagcgtcgccgcagcatgtttttccgctcggtttgaagcagtcacttgtaaaaagcggttttgtcgtcgaggatgagctactatatcacatgaagcttagtgactggaaggggcagatgggacatcctttaaccgcatgggggacggcaaaaagtcttagcgacggatcttctattatgaaaatttacgattccatttatattggagaagcaatcgctgaacaaaaattaaaaagaaaatatcctttctatgaagcaggtataatcattcttgttgtttgttacagcgaccaggcacagaaaattcccattgggtgcggcgagctgtttatcgatcatcaagagaaaacggctaaaatcgaagaagtggcaattttagatcagtttcaaaggaagggctacggcagtatcttagtgaaagaaatgctgtccatcgccaaatcactaggaatggaagcagcctacttagtggctgcaagcactgacggtgcagctcagttttacgaaaagctgacgtttaaaaaatatgagcgggtgcatactgtatttcattatttccttacatgaaataggcgtttgcacaaaccatttgggacttggcccgcataaaatgccgtatatcgtgataagaaaggatgaaaacagcatgtatggatactctgggtacggttacggatttggctgtgggacaaatacatttgtgttaattgttgtcttgttcattttattaattattgttggagccgcttttatttgctagatgctgaaatttcaaaagagccttccctattaggaaggctctttttatgtgaaaaagtttttgcggggaacgtcatgccgccatttggacactcatacaatatggtaaaaggggttttgaggtgggagcatgagcagttatttgattaagccagagcttagctcggcctatccggttgtcagttatgcgaagggttcatatgtttatgatcagaccggaaaaaaatatctcgacggctcgtcaggtgcggtgacatgtaatatcggccacggagttcgtgatgtgactgagaagctgaaagaacagcttgatcaggtgtcttttgcttaccgctcacagtttacgagtgagcccgccgagcaattagccgctctcttggcacaggagctgcccggagatgtgaattggtctttttttgtcaacagcggatcagaagcgatagaaacagctatgaaaatcgccattcagtattggcaggaaaaaaagcaaacacaaaaatccatctttttgtctcgatggagcagttaccacggaataactttgggagcgctttcattgtctggtttttatgaaaggagataccggttcacccatctcattgagcggtatccagctatctcagctccacatatttatcggctgaatcacgagacggaagaagactttgttcagactgcagctgatgaactggacaccatgattaaaagaatcggaagccaattcatcgccggctttgtggctgagcctattattggtgctgcaggagcagcgattactccgcctccgggatattatgagagattaagtgaggtatgccgcacacacgatgtgctttttattgcagatgaagtgatgacggggcttgggagaacaggaaggatgctcgcgacagagcattgggataccgtacctgatattgctgtactggggaagggactcggtgcggggtatgcacctattgctgctgccgtcgtatctgattctattattgaaaccataaaacaagggtcaggtgtgattatgagcggtcacacatatagtgcacatccctattcagccaaagctgctcttgaagttttgcgatatgtgttaaagcacggcttgatcaaacaatcagaaaaaaagggcgctgtgctgaagaagaagcttgatgaggcggcatctcaaagcggcattataggtgaggtgcgcggaaaaggactgctattaggcattgaatttgtggcagaccaaaaaacgaagaaagtgtttctgccagagcaggcgataacccagcttattgtcagcgaggcgaaaaaacgcgggctgattgtttatccttccaaagctggaatagacagtggagaaggagatgctgtcattattgctcctccttttactatttcagacggtgaaatggaagagcttatctctattttttcagaaacagttgcagcggtcgaaaaaaacttaaaaaaggattgacattaaatggcgccatttcaaaaagcaatcagcattgacacagcaattgcagatgttcgggatggatcggttctgatgtttggcggttttgggggagtcgggtcgcctccttcattgattgaagcgatattggacagcggtgtaacggatttaactgtgatttgcaatgacgccggtttcccggatatcgggatcggcccgcttattgttaatcaacgggtcaaaaccctgatcgcctcgcatatcggttccaatcctgtagccggaaaacagatgacagaggggacgttagaggttcaattttcacctcagggaacgcttgcggaacggattcgcgccggcggagcggggcttggcggtattttaaccgacgtgggcattgataatcaaatggtttgcgaaaaaaaggacatcgtaacagtggcgggaaaacgatacttgattgaagaggcgctgacggctgattttgctttcatcaatgcttacattgcagatgaattcggcaatctaacgtatgacaaaaccgcgcgcaatatgaacccgcttatggcaatggccgccaggagaacctttgccgaagctgagcgtatcgttccgaaaggtgagatttctgaagaaatgattgtcacaccgggggtttttgttgagggggttgtacgaagcgagggagtgaagtggaaatgggcttgggagtagcagaaagagaacagattgcaaaacgcgctgctgctgaaattaagcagggcatgattgtgaatctcggtatcggtatcccatccttggtaccgaactttttgaagcctgacatgcaggtcatgtttcaagcggaaaacggtgtccttggcattggagaaagtcccgaaaagggagaagaggatgcgcatttatgcaacgccgcgggatatcctgtccgcgctgtaaaaggggcttcttattttgatacaaccatgtcttttgcgatgatcagaaaaggcaaaattgacattacgattttaggcgccctgcaggtgagccaatcaggagatttggcaaattggcttgttccgggaaaaaaggtgcctggtatgggcggggcgatggagcttgcccaaaaagcgaaaaaagtggttgtcgtcatgagtcatacagatcaaaagggaaggcctaaattaacagaaagatgtacgctgccattaactgctgcaggctgtgtagatttgattattaccgaaaaagcggttcttgaggtcgatagccatcacttcattttaaaagagctgatgaatggctcgacaatcgatgaggtaacgaggctgacagaagctgaaatcaaaatagatatgcctttttcttaagagggggaatgaggatgcaagacattgaaagaaaagtaatcgggtggcttgatcagcattcggccaaagccattcgtcttctcaaaaggctgattggggaaaaaagcacattggggtcagagtttaacgcccaagctgttgtgcttgaaaagctgcggcaatttcatatggacattgatgtatgggagccaagcataaagcaattaaaacagcatccctactttaaatctaaccgatccgattttcatgagagcccgaatatcgtggctaaaaaaacgggagccggcggaggcaggtccctgattttgaacggccatatcgatgttgtgcctgaaggaagcgtaaaggattggaagtatgaaccgtatcaagctgtcgaagaaaacggtaaaatatacggccgcggctcaacggatatgaagggaggcaatacagcccttctttttgctttagaagccctgcacgcctgcgatgtcaaactgaagggagatgtattgtttcagagtgttgtagatgaagagtgcggcggcgccggtacactgtccgccatcatgagaggctatcgtgctgacggggcgctgattcctgaaccgacgaatatgaaactatttattaagcagcagggttcgatgtggtttcggatcactgtgaagggattatccgcacatgggggcacacgctatgaaggggtaagcgcgattgaaaaaagcatgcacgttatcacagcgatacaagagctggagaaagtccgcaatgcgagaatttcagatccgctgtatgacaatatcccaataccggtaccggtgaatatcggcaccatctcaggcggtgcctggccatcttcagttgcagaccgtgtcgtcatagaagggagatgcggaattgctccccatgagaaaccagaagctgtaaaacttgaattggaaaactggctgaaggatttagaataccatgacgaatggtttaaacgtcatcccgtacaagtagaatggtttggcgctcaatggctgccgaatgatttacctgatgatcaccctttaatttctgtgctgcaatcagcctatcaaaaaatgaaacagacagagccgattattgaggcttccccgtggggaacggatggagggcttttgtaccatgcaggagatacaccagtaatcgttttcgggccgggggaaacaaaaacggctcatcaggccaatgaatacattgaggttgaagccatgatagaatctgctaaaattattgcactttttgtcatggattggtgcgggcttcatacagatggggaggatgcggatgctcaagtcaataaagagtagcggtgtcacagcagttttggaccatgacggttttaataaacgaatcagagtggtccgttatgacggagccattgagaaggccctgccggatatcgtggcagcggcaaaagaagagaatgcagaaaaaatcatcgtctatgcgaagcagcatgatgagccaatgcttgccaaacaattatttgcgccggagggctatctaaagggctattatctcggccattcggcttgtgtcatggtacgttacctttcagaaagccggagacaaacagattcttatacagaggaacaggagatcatcgaagccatatatcgcacagcgccccgtcttcgcaacgacagtacacccgtttttacgatgagaaaagcagaaacaaacgacatgtaccagctatcgatgctgtataaaaaagtattccgcacgtacccaaccccggtatttgaccccgcttatattgaaaagacgatgaatgcaaatacggtgtattatatcatgcttgatcatgaccgcctgatcagcgcagcaagcgcagaaatcaatccagagcttgggcatgcagaaataaccgattgcgctgtgctgccggaatatcgcggccattcgttaacaagctttttaatcgaggcgttagaaaaagaaatggctggaaaggatatctttcatgtgttttctctcgcccgtgcttcgtcttttgggatgaatgctgtgttgtaccattcaggttatcagtatggcggaaggctgatcaataattgctttatagccgaaggccttgaaaacatgaatatttggtgcaagcaactgtaagtcaaaatatgcgcgaggaggagttcgtttgaaaaacaaatggtataaaccgaaacggcattggaaggagatcgagttatggaaggacgttccggaagagaaatggaacgattggctttggcagctgacacacactgtaagaacgttagatgatttaaagaaagtcattaatctgaccgaggatgaagaggaaggcgtcagaatttctaccaaaacgatccccttaaatattacaccttactatgcttctttaatggaccccgacaatccgagatgcccggtacgcatgcagtctgtgccgctttctgaagaaatgcacaaaacaaaatacgatctggaagacccgcttcatgaggatgaagattcaccggtacccggtctgacacaccgctatcccgaccgtgtgctgtttcttgtcacgaatcaatgttccatgtactgccgctactgcacaagaaggcgcttttccggacaaatcggaatgggagtccccaaaaaacagcttgatgctgcaattgcttatatccgggaaacacctgaaatccgcgattgtttaatttcaggcggtgatgggctgctcatcaacgaccaaattttagaatatattttaaaagagctgcgcagcattccgcatctggaagtcatcagaatcggaacaagagcgcccgttgtctttccgcagcgcattaccgatcatctgtgcgagatattgaaaaaatatcatccggtctggctgaatacccattttaacacaagcatcgaaatgacagaagaatccgttgaggcatgtgaaaagctggtgaacgcgggagtgccggtcggaaatcaggctgtcgtattagcaggtattaatgattcggttccaattatgaaaaagctcatgcatgacttggtaaaaatcagagtccgtccttattatatttaccaatgtgatctgtcagaaggaattgggcatttcagagctcctgtttccaaaggtttggagatcattgaagggctgagaggtcatacctcaggctatgcggttcctacctttgtcgttgacgcaccaggcggcggcggtaaaatcgccctgcagccaaactatgtactgtcacaaagtcctgacaaagtgatcttaagaaattttgaaggtgtgattacgtcatatccggaaccagagaattatatccccaatcaggcagacgcctattttgagtccgttttccctgaaaccgctgacaaaaaggagccgatcgggctgagtgccatttttgctgacaaagaggtttcgtttacacctgaaaatgtagacagaatcaaaaggagagaggcatacatcgcaaatccggagcatgaaacattaaaaaatcggcgtgagaaaagagatcagctcaaagaaaagaaatttttggcgcagcagaaaaaacagaaaaagactgaatgcggaggggattcttcatgaaaacatgcgaatggtgcggcgagcttgaagcggtgcccggcaggaacacggtgtactgggagctccctgatggatcgagggctatagaactgacagacacccctgccatggtatgttcttcctgcggtatgacctatcaagaggaaaacacggttaaggagattgaggatcagctgcttttaattcaaacaaaaaaactgcctgaaagcctgacatatcagcagctcatggagacagaaagaattttgaaacgcaactattttgacttctcctgagtcatgtttcagtattcttttgttgtaattttacacttgaactgtataatagaacaacaaaagacagacaccaggaggggaaacccatgaaatccttttatcactatttattgaaatacagacaccctaagccgaaggacagcatcagtgaatttgccaatcaggcgtatgaggatcacagctttccaaaaacatcaaccgattatcatgaaatcagttcatatttggagctgaatgctgattaccttcacacgatggcgacgtttgatgaagcttgggatcaatacgagtctgaagtgcacggcagataatagctgtttcatccgcagatcactgcggatttttttatgtccatacccataccataattggatatttcctttggttttcatgcccatgcgaattggcttcacccggcatacgatagcgtatgagaaatgttgcggcgagggggagacaccatgaagcaaaataaaccgaaattccaagtaggggatatcgtagtcgtcattatgtatggaacagtcggcaccatcacaaaagtacaccaaattgataaacactatctttatgaagtcaatcataacgaagttttatactttgaatcatctattcagctttataaagattatgagggtgtcattgtcgacatggagaagcttgatattgagtatgaattccttattggggacgttgtttatgttaaagattatggaaaagaactctttcgcattatcggccatagaacagaaatttggagatatttagaagatggctgggaagatatcatttatgagctgacccgtttaaaggatggagagtggcttgaaacggaggaagaggatctcacgctggtgcttagaaaatatgaaatggaccagtttgtgcatcagctgttgtttgtccattatgtcggagaaactggccatgagatcggcgaagatatcgcatcgtctgctcttcttcagtttgaaggcgatgatgaagatcaagatacccttcacatccttgctgtgtcaattgttgatgagcttctggatatttataatgactacaaaattctgtacgaaatgtttcaggatgaagaatataaagacatgatgatgtttgttttggaaagtttaaaagagcatttcagttaatttgtgaacatacggatcaagacatataaaaaatatggcagacagccccaaatcatcacacgcgtcattcctttgagcgttttttccattatgatatcaaatctttctccgtccagtgcttccatcattttagcaatcatagcgtcagcctcccatggctcgttttttattcaatatatgactgaaagaattgtttagaacaccgggtataattcagcctgttttttcataaaacataaaaaaggaggcggtacggagatgaaagaaatagatcttgtgattgatacggaagaaatcgctgaatttttttacagagagcttgcaagacggggctacataccgagtgaggatgagctgtttgaaatcgctgatattacctttgattatttgatagaaaaatgtatgatagatgaagagctggatgaagatgagtgaggcttaaaaccggagcggtcagctccggttttattattcatgttctatgacttctgtgaaaattgaggtggttaaaattgtacaagcccgttagtttgtttcttttctttttaattctagctgcggccattcatacaaatgctgttcaatctgcagatgaagcaataagcaaggcagctgttttgatccgtcagccatggcttaatgaagtcatgacggggatcacgcatcttggtgcttcttcttttctgctccctctaattgtcatcattggagcaggcatgtttttctacagaaaaacatgggacggcctgttgatgctcttagtattcggcacagatcggctgttaaacaaagtcttaaaagaatggatcgaaagagtgaggcctgattttgcaccgctggttcatgaatcatccttcagttttccgagcggccattccatgaatgctgcttgtgtctatcctgttattgcttactttttagtgaaacatctcccgtttttgtctaagcataaaaaaatggtatatatcatagccggtgtaattgctgttttagtcggcataagcagagtgtatctgggggttcattttgtgacagacgtgttaggaggctttagcctcggcttgcttctgtttttcctagtaaaaggttttgacgaaaagattaagcggtttcgacaaaaatagagagaggaaaacacagcaaaaacgccaatatgttaaagaaataaaagggaggggatcttgatgatgttatccgtgtttaaaaagaagtcttgttcctatgacgtgacaatatttcagacaccccggtttggcgaaaaaaagggctacagagccgtctatcgaactgaactgaacgggagcgatcatcaagacgtgctgaaaagagcattctctttgtttaatgtattcgacactgttccgagtgattatgatgcaagattcatggccacaggggacgtgatcctgattgatgaaggcagaaaagggaaaacatattatcaactgcttcccgccggctggaggaaaatcaatcgtctgattgtacaaacgacataatgaaaagaaaactgcggaaacccgcagttttctgcagttttaaggcttgcgtttggcagcagaatattctttcccgtgtgcttcttcagctgcaatgatatctttttcaggtatatgattgttctttttttggccggtgatccggttgcgatgttttttacccatgtcccacccctccttcctgcggttaggttttcaaattaacaccccgattatccgtttttctgaggaagtgcctaacagatcctcgaacatttcttttttcgacatattcctttataatcaatgctgaagtttgtttcatcatgacattcgttgtaaaatggacgggctggatgataatttagatttacaggaggatatgagatgagtgtacatataggtgctgaaaaaggacaaattgcggatactgtgcttttgccgggagatcctctcagagcaaaatttattgcagaaacgtatcttgaaaatgtagaatgctacaatgaagtcagaggcatgtatggatttacgggtacatataaaggtaaaaaaatctcagtacaaggcacgggaatgggcgttccgtctatttcaatttatgtgaatgaattaattcaaagctacgatgtgcaaaatctaataagagtcggttcctgcggcgctattcgtaaagatgtcaaagtgcgagacgtcattttggcgatgacctcctcaactgattcacaaatgaatagagttgctttcggaagcgttgattttgcgccttgcgcagatttcgagcttttaaaaaatgcctatgatgccgcaaaggataaaggtgtgccggtgactgtaggaagcgtatttacagctgaccagttctacaacgacgattcgcaaattgaaaaacttgcaaaatacggtgtgcttggcgttgaaatggaaacaactgcattgtatacattagcagcgaaacacggaagaaaagccctgtcaattctcaccgtgagtgatcacgtattaacaggagaagaaacgacagcggaagagcgtcaaacgacatttcatgatatgatagaagtggctttacattccgtatcacaataaaatatatcaagaggcgtgctgggtgccggcagcctcttctttatgaatgcggaaacgattgataaaaggaaggtaatgtaatatgaaaaagtccggtaaatggttctcactggctgccgctctgagtgtaacggcaatagtcggagccggctgcagcatgtcgaacggagatgctcaaaaggatacgaaaaccacagcagaaacaaagcaaacagaacaaaaaacagctgacagcaaaaaatcaaacactcaaaacagtgagttttcattggaaagccagtatttcaatgatattaaaaaagtcgatggtctggaaaccattcaaaatccagaaaatatactcgcgcttgtcaataaacaatacgcattgcccggaaactatgaacctagcgatcttgtcatacctgatgtagagttttcttttgaagaaaagattcaaaaacgttacatcagaaaagaagccgccgacgcattaaaaacaatgttcgatgctgccaaaaaggaaggctatgaactggcagctgtctcagggtatcgttcgtatgacagacagaaagtcatttttgacaatgaagtaagcctaaaaggggaaaagaaggcaaaggaagcggtcgcttacccgggtgaaagcgagcatcaaacaggccttgcgatggacatttcgagccggagcaatggctttgagctaaatgaagcgttcggaagcacggcagacgggaaatgggtgcaggacaatgcttataaatatggctttatcattcgctatccgaaaaataaagaagatatcacgaaatatgaatatgagccatggcatctgcgctatgtaggcaaaaaagccgcaaaggtcattcaagataatgatttaacgcttgaagagtactttgaaaaagtgaagaaaatttaaaatgaaaagcccgcttacactagataagcgggcttcattgtgtctggtgaatctagcatttgttctatgcttaccagaagaataaaccagccagagccactcctgcaattaaaccgagggaaataccgtaagctgctccgtatccccaataaccgccccaatatccgtaaccgaaacctcttggccctccgccgaccggagctataaaaactctgtctcttgttacacgggtaattctgccgacgtgaactctcccgcctctctctgtaattctgacgactttaccttgatggtttttgcaaagatgataatatctctccaatattgttcccctcctatcctgactttctatcagcatatgatagataggaaaaaaaggttggacgaaaacagggggcgatacgccgttttacttgtacgcgataaaaatacaatgacccatgtactcactatataactgcatgagctgataatgtgtttgaagcgtatcgtaatagatgggatcaatcgtttgcgataaatccatttctgtggttggttcaaattccatgtcttccggaagaagtgacatcgcttctgttttttgaaagccataggatcttaggagtttatgccattcgctttcttcatgtaagcaagtaaatccgtaaaaatccatcatttgcttcttttctgcagggggcattggtttttttaaagcagcttcgataccaatcagcatcccgccgggttttaaaactcttgaaatttcttgaagagaggatgtcaggcgtgaaaaactgaggaccgattctgacaggacgcaggaaaaggactcagaagaaaacgggagatgttccagctccgcctgatatgcagggatggcaagcctttcattcgcaaatctttttttcgctttctcaagcataataggatctttatcaacgactgttacaggatacagcaaatgtcctaaataagccgccgtttgccctgttccgcatccggcatcaagaatcggctgatccggagagggtgcagccttttgcaagaccgcttttgaaaaagccagcccgcctgggtgcgcccctgcgacaccgaataaggacagcatttctaaatatcggctcaatatcgaatcctcctttttccttatcatatgtcgtataaagacataggtttatgaaaagcaaaagaagggcgtttctctttcgtttctgctccgagttgacgaataagaattcgtccatgataataatgtaagaagaaaaaggtggtgtttaattgaaacggcaattaaaactgttttttattgtgctgatcactgcagttgtcgcttcggcgcttactttatttattacgggcaattccagtatcctgggccaaaaatcagcaagcacaggagacagcaagttcgacaaattaaataaagcgtatgagcaaatcaaaagtgattattatcaaaaaacagatgatgacaaattagtagacggagcaattaaaggaatgattcaatcactggatgatccgtattctacatatatggatcaagagcaagcgaaatcattcgacgagacgatttcagcatcttttgaaggaatcggagcccaagtagaggagaaagacggagaaatccttattgtatccccaattaaaggttcacctgctgaaaaagccggtatcaaaccgagggaccaaatcattaaggtaaatggaaaaagcgtaaaaggcatgaatgtaaatgaagccgtcgctttaatccgaggcaaaaagggcacaaaggtgaagcttgaactgaacagagcgggagtggggaatatcgatctttccattaagcgcgataccattcctgtagagactgtctattcagagatgaaagacaacaacattggggaaattcaaatcacttctttctctgaaacaacagctaaagaactgacagatgcgattgacagtttagagaaaaaaggagccaaaggctatattttagacttgagaggcaacccgggcggcttaatggaacaggcgattacgatgagcaacctgttcattgataaagggaaaaacatcatgcaggttgaatacaaaaacggttcaaaagaagtcatgaaggccgaaaaagaacggaaagtgaccaagccgaccgtcgttttagtaaatgacggtacagcaagcgcagccgaaattatggccgctgcccttcatgaatcgtcaaacgtaccgttaatcggcgagacgacattcggaaaaggtacagtgcaaacggcaaaagaatatgatgatggctctactgtcaaactgacagttgccaaatggctgactgctgacggcgaatggattcacaaaaaaggcatcaagcctcaagtgaaagctgagctgcctgattacgcgaagctgccgtatttggacgcagataaaacgtacaaatcaggtgatacaggcacaaacgttaaagtggctcagaaaatgctcaaagcacttggttacaaggtaaacgttaacagtacgtatgaccaggactttgtatctgtcgtcaaacagttccagaaaaaagagaagctgaaagagacaggcatactgactggcgatacaacaacgaaattaatgatagaacttcaaaagaagctgtctgataatgatacgcaaatggaaaaggcaattgaaacactgaaaaaagaaatgtaaaaaaaccatacgcggctgccgcgtatggtttttttatgcacccttttgatttggattagcgtcttgttttttgccaaataaaccttcaatgacaggattggatcccgcgtttttaacgaacagcggattcaggatcaccacagcgatcatgttggcggccaatccccagaatccttcataaatgccatgtgcggattgagtggtatacacaataaacgtaaccgcaaggccgactaataatccgataactgtcgcttcttttgtttgacgcttccagaacaggctgacagcaatcgcagggaagatttgcaccataccggatacacctaatagctgaagtgtcactaaggcagtcggaaacagcattccaaacagcagcgcgagaccgatgacaacaaacaccattgaacgtgtgacaagagtcagcttgctttgcgacacattcggatgaatcaaatcccggtataggttgttggcgaataaattcgatgcgccgattgccataatggaacaaggtattaatgaagcaagagcgatagtggcatatgcaaagccttgtgccacgccgccgtaagatgtttgaatcaaatgcagtagcgccagtcttggatttgtatcttccggcagaacaagaaaggcgataaagccaagaaaaataactaaaattaacacgatattataaagcggcaaaaacatgctgttttttcttactgaatcagcgcttttcgccgtgaaaacacctgtagcggcatgcgcccacataaaaagtgccagagcggaaacaatagatgctgtgataaaccaaggaatgccttttggcccttctgacggtatcgtcagcatttgcggcgcttccttcactaacgtgtcaatcattggcgtccagccgttaaaatgaatgagagggagggacaccaccataaacagcataatgacccatactaaaatgtccttaatgatggctgtatatgtgggccctttaatcccgctgaagaatgtgtaaagagcaacaagaataaatgaaatgatcacaacgaattttacgttaatatagccagtgccggcaacctgaagcgtgtcttgaatgccgctcagctgaaggcatatgtacggaataagcatgagtaccccaacgatggcaacgaggcttgccaaaagcttactgttaaaacgttcccgggcataatccgcgagtgttgttaatttatgaattttcgcaactttccaaagttttggcaagaagaagtaggcgataaagtaggccaacacagaataaggaatggcgaaaaatgcaacacttccgcctgtaaaagcagtactggtcaaccctaagaaagtataggccgtataaaggtcagcgcctactaaaaaccagacgagaagaccgccgaagcgtctgccgccgacagaccattcttccacagaagtacgtgaggatttgtctcttccggcgagaaagccgatacagacaacggttaaaacaataatagcagtaatgagaagtgcagtcagattcccttgcattattcaagtcctccatcttttttttgcatctgataaatgccaaacgagcataacggcgtaacaataatccacagcagcagccaaaagtggaaaaacggcaggccgaacataatcggttctattcgattcacaagcggcaaaagcgcgagctgaacgaatggcaaaagaatgagaataacaataagtgcttttttaaccatttactttcctcctgaaacatgataatgctcactataatagcagttgtaagaaaagatcacaagataattattagaaaaaaatgattttttcaattatttaatcaaaacacatggtttgcatccttttcaataaaggtttaaaataataaatatcttgaaatcgagataaataggagtgagaaaatgaaaacagaaggattgcaccatgtcacagcattcgccagagatccgcaagaaaacttgcgattttatacagaagtgcttgggctcaggctcgttaaaaaaacagtaaactttgatgatcccggaacgtatcatttttactttgggaatcaaaacggagatcccggtacaataatgaccttttttccgttccaaggaagcggacagggaacggtaggaaaaggccaagcgggccgggtgtacttttcagttccctcaggctccctgtctttttggaaggaacgtcttgagaaaagcgggctgagcctagaggaaaaaacgttgtttggtgaaaaaggtcttatttttgatgatacagaagaccttccgctggcgatcatggaggatgcgaaaagcagcaaaagcgagtggacgcctgacgggatcacaacaaatgaagcaattacgggaatgaaaggtgtgctgctatattcctacgacccgcaggccaccatacaattgttaacggaaagctttggatacaccaaagtggccgaagaagaccagattgtcagactggcatcctcagcggccgtcggcggtgtcattgatgtccatttacatcctgaaaaaagaggagtcggaggatatggtacggtacaccatgtagcgtttcggactaagaaaacggaacaggcgaaatggctgccgattattgctgaaaaccatctgcctgcgtcagaaattctcgacagggaatactttacatcagtttatttcagggagaaaggcggtatcttatttgaaattgccacagatgaaccgggctttatgacagatgaaacgtttgctgagctagggacttccttaaaactgcctgaatggctggagaaacatagacaacaaattacagacattttacctgaactttaaaagggggaatttataatgaagcatatttatgaaaaaggaacatctgacaacgtacttttgctgttgcatggcacgggcggtaatgaacacgatctgctttcattggggcggtttatagaccctgatgcccatttgcttggtgtcagaggatcggtgcttgaaaatggaatgccgcgatttttcaaacgtctgagtgaaggagtttttgatgaaaaggatcttgtggtgcggacaagagaattgaaagattttatcgacgaggctgcagaaacgcatcagtttaatcgcggccgagtgattgcagtcggttattcaaacggcgcaaacattgcggcaagcctgctttttcattataaagatgtgttaaaaggggctattctgcatcacccaatggttccgattcggggtatcgagctgcctgatatggcggggctccctgtttttatcggtgccgggaaatacgatcctctctgcacgaaggaagaatcagaagagctttaccgctatttacgtgacagcggggcatcagcctccgttttctggcaggacgggggccatcagctgactcagcatgaagctgaacaggctcgtaaatggtacaaagaggcgattgtataaaaaaaccttagtccggatttcggactaaggtttttcatatccttacagccaagttgatacttttgaaagcggcagacggttgctttgatgcgcaggcttcactgctttgccgattgaaataagcataaccggaacatagcgctcactgatatcaaattgcttttggaactgctctttgttaaatccgccgattgcgcaagtgtcataaccttttgcttttgcggcaatcataagctgcatagcagctaaagaagcatttaagaaagcggaatcacgtgcgaattgctcgctttggtaagcaccgttgatttggccgagcaatgtttgtttgatttcatccgtaatatagccttggcttgctaattcagcataaacttcttcaccgttttcatttgcctttaaatcgcctaaaatggcaacaacagcagaagactcaacgatttgtttttgattatacgctacaggaagaagctccgcttttgattcatcgctgtggaatactgtaaaatgccaatgctgaaggttccaagcggaaggcgctttagcggcaaggtctaatagctcagtcagctcctccttagagatcggggcatttgtatcatattcctttacagatgcacgtgcttttaaaacatccagagtattcgtcatagtgtttcctccttcggataaacgtggtatgataatagaaaagttagaagcttactaaatgtaacttgaaagattattgtaatggatcattgaatacatgtcaatcaatagatgaagggatgaaggcttgtgggaaatacgatgtgccctaaaatggaatccgcattctcattgctgggaaaacgatggaacggtctgatcatccatgtgctaatggatgggccgaaacggtttaaagagataacggaaacaatacctatgatcagccaaaaaatgttggcagagcgcttgaaggagcttgaacaaaacgagattgtcgaacggcaggttctccctgaaacgccggtcaaagtcatctacacgctgactgaaaaaggaacagcgcttcaagctgtatttcaagagatgcaggcatgggccgatcaattttgcgagcctggtgacacagtgtgtgaagaagagaaataaggaaagcggcgtctgaaaaaacgctcttgtttccatggtgagtcatgtaagtacggttcacacccacacccgtttacatgactttttatatttgtcagactgacatttccggattggcaaaagtgtcatgtgcatatgaaggggatatataaaataggaaatgatcaataagctataacatccaacctgttgtaaatggggattatgatgtatcttattatgcaaatcagcaaaattttatattttcggccaaaacccagtcagcttccaattggcatttaaaccggatataaaaggaaatccaggtttttcgtattgctggatgcttctatactgatgactttcgcatttatgaaaaaagagagagcttctttggagctctctcttcttttttttgtggggagacgaaatcttatagttttccattcaaaaattgcgcctcaccgagaccgaaactccagtctgcgtcaccattctcagtaatagataccatgaggtcttcaggggaaattccgcatttttcttctagcctttcagcaagcagagcatacaatttttccttttggctttcggttcttgctttgcttgtcatgctaatgatgaccatatcctttgttctctgaaaccctaatcccgtatcctggattataagctcgtttgcgggatgctgatggacaatttgataacggtctctttccggaacaccaaacgcttcaaccatcgcttggtgagcagtatctaataacaattgcagcgatttttcgtcacggccttcaattacatcaaaacgcaataatggcatgtgtactcctccttttgtgaagttgttatccgtctgttctcatattgtctcatttgcttccagacaatggatagatataatgattggcagtcaactttaaaaaacataatacataaccaaaagttaatcaacatataactaataaatcattgggttaggcggtaggtaatcgagacaagctcataaaaacgcttgacagtcattgattaggagattagtatgaacatattagttgatcaaaagataacaatcatataaccaagacgtttttagttattaatgaaagcgctttctgttcatctaggcatgaaaagcgccaaaacattgtcgcgagaatcatataaaacacttttggaggggtaccatgccgattttaattgtagctgtcggagtgctgattctgttatttctcattattaaagtaaaattaaatacctttgtctcactgattgtcgtttcatttttagtagccatcggacttggaatggatatcaataaaattgttctttcaattgagactggaattggcgggcagctggggcatttagctttagtgtttggatttggcgcgatgcttgggaggcttgtctcagatgctgggggcggctaccggattgccattacgctgattgacaaattcgggaggaaacgaatacaggcggcggttgtggttgcctcttttatcatcgggattgccctattttttgaagtcggtcttgttctgttgataccgattgtttacgcgattgctaaagaattaaaaatgccttttctgtatctgggaatcccgatggccgccgccttaaatgttactcacggatttttgcccccgcatcctgctccaactgctatctcagttgcatacggtgcccatattggccaggtgctgctttttggaatcatcatcgctgttccgacaactgtgattgccgggcctttatttaataaatttgcgatgaaacggtttcctggtgcgtatcaaaagcatggaaacttatcggggttaggaccgaggaaagaatttcagctggatgaaacaccgggctttgcgatcagtgctgtcacgtctttattcccggttatctttatggcaatggcaacagttttttctttattattgagtgaacattcaaaaggaaaagacattatagaatttatcggcactccgggaacggcaatgctcatttcgctgttgcttgcactctatacgatgggatatgcccgtaaaatatctatgcaggaaatcagcagatctatttcagaatcaatttcgcaaattgcgatgatgctgctcatcataggagggggaggagcgtttaaacaggtgctgattgacggcggggtcggcgattatgtcgctgattttttccgtcaaacaaacatgtcgccgctattcgttgcatggaccatcgccgcggttttgcgtctgtgtctaggctctgctaccgtggctgcgcttaccacagcgggaatggcagctccgcttatagaggctggcagtgtaaaccccgcgttaatggtgcttgcaacaggagccggcagtgtcattgcgtgtcatgtaaatgatgcaggattttggatggtaaaggaatttttcggcttgagtatgaaagaaacatttcaaacctggacgctgcttacaacagttctttcggttacagggctcggctgtgtgttattggcagggcttgtgatgtaacaatcatagacagtccgtagcccaatcgtttttcttccttgctgaatactttacgtataggcagacataaaggaggaaaaattcatgtaccctcatcattcgtatttacgcggaatcccaggtccagccggatatccggcgcgtagtccttttttgtttggcgctcctctagtcggcggtttattaggcggttttctcgggagtgcgctgtttaactattctcgtccctatgcctatcctcctggcccttatggatatggaggcggaccgtacggttttggtgccggcgtgccatacgggggatatcccggtttctattaataaaaaacggcctgcatcgattgcaggccgttttttatcggatgatttctacctcggacatattgtagtcttgctgcttttgaaacatgacttccagaaggccatccttatagacggcttttgttcctttgcgtttgactaaacaaggaaggtttacttttttcggatgatctgctcttgggaagttttccaaccataattcgtgagatgtgtgtttgattctcacttgttccagccattcttcgctgattggcacctttacaaacacatggtctgctgtttcgaatatatcaatatcaggttttggatcaggtttggcgggctgttctttttgggggagaggatcgcggaaaggaaattgagccgcataatcactgccgaacacactttccatcacacgattgacatacgtttcaacttctttcggatcagctttttttaatgcttctttagaaaattgattgtggaaaggaaagtacttgttccactcaaacattgtcttcacatcctttcttcacggacaaaatagtatatgcccgccagatctttcacgtgatataatataagatgctctaaagaaaggcagggatataaatgcaatattcagaaacaaaaaaaggcgttatttacacagccgtttcctttatcatgtggggcctgtttccgctctattggaagcttctcgaacagctgccggctcttgatattttggctcatcgtattatatggtcttttgtttttatgtgtatcgtactttttttcttgcggcaatggaaaataggatggcaggagttgcgctctctgaaaaagaacggagggatcctctctttatttcttgcttctatcctgatttcgatcaactggtttgtatacatatgggctgtaaaccatggctttttgcttgaggctagtcttggctattacattaatccgcttgtatcagtgctccttgggattttatttttaaaggaaaaactgaatcgcctgcaattagtggccgtttcgattgcggcagccggtgtcatcatctcggcgttccaatacggctccattccttatgttgcgcttctcctcgcattcagctttgggctgtacgggttaagcaaaaaaagaacaagcctgacgagcgccatcggtttaacgctggaaacattcatgattatgccgattgcattggggtatttgctgttcagcggacatgttcagccagcgggtgcagaaagcggagggacgtggctgcttctctttttggccggtgtgtttacggctttgccgctcttattgtttgcggaaggagcgaaacggctgccgctgtatcaagtcggtatcttacaatatattgcgccgaccattaccctgttgatcgggctgtttgtttaccatgagccattttcaagctcgaaggcttttacattcagctgtatatgggctgcgctgctcttgtttacgttttcacaagtgaagtggaaacgggcgtcaaaaagccattgaggcctttggcttttcagctgatgcatatattatgtataatcatttcatgtatgtaagacataaaggagcaagacgatggacaatgataaagagatagtgaaagcctatgcttcactttggaataaccgatctctcgcacatgatgacgcagaagcggtagcagaggcgattgatcttgagctcttggataaacgaacacatccaagactccgaaaaccgatgctggaaaaatattttgccgcgattcagcgcattgtgaattcacagctcgaaccggctgtgaaatatcagctggtcaaattacatacagaacgtgcagagtatttaaaagaagaaagaggggagcaatcatgaaagcgatcataaaagaagatgtgcaagcatctttagaacgatatgcggaccgccctgtatatatccatttagaaaccaccacaggttcttattcagcgcacttaaatgaaaagaacatgacggttgttgcgtatatccgcaatgcaaaagtcacttatcatcaggcaaaaatcaaaggcaacgggccttaccgcgttggcttgaaaacagaagaaggctggatttatgctgaaggcttgactgaatacacggtagatgaagaaaaccgtttattaatggcgggacacctgccgggcggtaaactggctatttctctgcaaatcagcgaaaaaccgttcacagtttaaagaaaagggtgaataataatgaaagaacatgtactagtaatcctgcctcaccctgatgatgaatcatatggagtggcaggcctcattgccttaaacagaaaaaaagacattcccgttacgtatgcctgcgccactttaggtgaaatgggcagaaatatgggcgatccatttttcgcgaatcgtgaaacgttgccgctgctaagaaaacaagagctcatcaacgcttgcaaagaaatggatatcaatgaccttcgtatgcttggactccgtgacaaaacgctcgaatttgaagatgatgagtatttagctgatatcatggaagagatcatagatgatgtaaaaccaagtttaattgtcacattttatcccggacacggtgtgcaccctgaccatgatgcatgcggggaagcggttatccgtgcattatatcgcaaaaagaaagaagaccgtccgcgcacgctctgcatggccattacccgcaacagagaagaggttctcggcgaagctgatgtcgtacttgatatcaaagaagtagctgatattaaaatgaatgcgttaagagctcaccgcacacaaacagaaggcatgctcagagagcttgaagagaaattgaaaaataatgaacctgttatggcaacatggtttgaagaagaaatttattggacgtatcaatggaatgattaatcaaaaaggtataaggccttaagccttataccttttttaattttaagtccgatgcaattgctgaagcgagagtggatctcaaggaaataccttcgaaagacaaacctagctgaaccgctgtttgcgcgatttccggacggattccagacaaagttgaagaaacaccgattaaacgaagcgcctcaatcagactgaacagctgatgggcaaccatcgtatcaatcacagctactcctgacaaatcaatatacagttgtgtcaccttttttttcgcacattgatgcagtgtgttttccataatcagcttggcgcggactgtatcaatatctccgattaaaggcagcagtccgacgctgtgaaacagcacgatgaccggagcgctcaattcagtaatcatatctttttgggcctgaagctgaaggcttgtgtttttgtacatttcttctataaaaatatgaatcacaagatcaaacgcttttataagggcgtgatacaggtcttcggcttcttcgcttttcacagtatcctgattgagatggacaaattctttcacataagaaacatataaatctctcactctgacaaactcccgaataatatagtggataggagtttttaaatgctcttgatcctgtgtgacttcaaaggcccattctttcagtataggcaagtatacgtcctcatcatctataaaaatacggtttattttatagttaaaggcaagattctggctctttaaattgtgaatgacaacaggatctgttgaggcataaatggaattgggatcagtctcctcgattgtttcataccacgttgaactgatggtttccgcatgctgggaaagatactcgaataattttttgttttttgccatgattgatcacctcttttaaatgtgttgtttttgcgaataacgtttttgcagttttgccagcctgaaaaacagcccaactgctccggcggcgagtcctgctattaatccaatccaatagccgaatgcaccgaggcttgtaaacgtaccgaccatataaccgatcggaaggccaatgacccagtaagagacaaaagctgccgcaagcgtatagttcacatctttgtaccctctgagtgctccctggatcggtgcggcaacagcatcggaaagctgaaaaaatagcgcataaattaaaaagtgctgtgtcagccggagcacatcggggtcagaagtgtacatgccagcaatttgctctctgaataaaaggatacaggcggcagtgaacaaagaaaagccgatcgccatcatgatgccgattaagctatatgagcgtgcgtccttaaaacgggctgcacccgcttcaaacccgacaacaattgttagagccatggacacgctaagcggcagcatatataaaagagacgcaaaattcatggctgcctggtgggacgcgatggtcactgtatgaaaatggctcatgagaagcgtgacagctgcgaaaatgctcgtttcaaaaaacacggcgaacccaataggcagcccgattttgagcaaatttttgcatgctttccaagagaacttatacatggtaaggaaaatcccgtattcagaaaacggtgcgtttttatgaataatgaaaaaactgatgatgcagatacaccagtaagttaacgcggatgccagccccgcgcctacacccccaagtcccggcattccgaacttcccgaagataaatacataattcaatacaaaattgattggaagagaactgagtgtaatcatcatggtgactctcgtttttcctaatgagtcgatgaatgatctcaacacggtgtaaacaaataaagggaaaattcccagtgataaaaagcctaaaaagtgtttagcaatctgatgcacgtgaatatcaaggttcaatcggccaagaataaggtcaactgcagcatatccaatcaataaaacggcgatgctaagtagcgcggccacgtatacagcctgtaaaacagtaaagggaatcttctgttttttctctgcgcctaataactgagctacaatcggggtgaccgccattaatatacctgcaagtcctgtgtaaacaggggtccaaaggcttgagccaatcgcgacacccgctaaatcagcggggctgactttccctgacatcaccgtatctagaaaagtcataagagaaagccccgcctgggtaatgaatatcggtattaaaatgtgcaagagctgtttgatttttttccgggcattttgagtttctttcatacattgatctccgtttctttttcataacgagagaaattataacattttatgtataaaaagcaatgaacgccgggcctattctttttttgtcggtttcgtttttctaaacatttgggcataaataaaagaaagcgaaatcacgcctaaaaaggtgcaaatatactgaatgattctttcgatttccattctttacatccctcctttaccaatagaatgtgcatcaataagataagcattcgtgaaaagttggaaatttgaacaggagatgaagattatgcgctatgagcagatatcagaaaatgcgttcaaggggaaaatacaggtgtacctagagcaaatattaggtgatgcatctctaatcttgaaaacgcttcacgaaaaagaccagtgtctcctttgtgaattagatgaattagggcacatttttcaggacatgcaggggattgcatcctccttttatttgcaatcatacattgaggaatttacgccggcatttattgagctggccaaggcgattaaagccttatcggaacataagcatggagctttaattgtgattgaaagagcggacccggttgaacattttattcaaaaaggcacctcactacacgccgagatcagctcttcattaattgaaagcatcttttttcctggaaaccctcttcatgacggcgctttattggtgagagaaaataaactcgtgtcagcagccaatgtgctccctttgacgacgaaggaagtggatattcatttgggaacccggcaccgggcggctcttggtatgtcgggctatacggatgcactggtgctcgtggtttcagaggaaacagggaagatgtcgtttgccaaagacggtgtattatatccgttaatttcaccaagaacgtaaaaataataaaaagggcctgattaagaatcctatcatgagacaaaatgactgaattcgtatctttattaaagcattcgcttcaagctgaatgctttttgtcttgaagacagggaatataagctggtagaaaagttatatgtgatgaatattaataaagtgaaatactttacctgtttatgtatttatagtaccgtataaaatattatataaattttcaaaggaagggtgctgccgcatggcaaatgtattaatgatcggtttccccggtgaagggcatattaatccctctatcggtgtgatgaaggagctgaaatcccggggagaaaacattacgtactacgcagtgaaggaatataaagaaaaaatcacagctcttgatatagagtttcgtgagtatcatgatttcaggggagattacttcgggaaaaacgcaaccggcgatgaagaaagagatttcacagaaatgctctgcgcttttttgaaagcctgtaaggatatcgcgactcatatttatgaggaagtcaaacatgaatcgtatgattatgtcatatatgatcaccatcttctcgcgggtaaagtcattgccaacatgctgaagctgccaagattttcattgtgtacaacctttgcgatgaatgaggaatttgcgaaggaaatgatgggagcgtacatgaaaggatcacttgaagattcgcctcattatgaatcataccagcagcttgcagaaacgttaaatgctgattttcaagcagagatcaagaagccatttgatgtttttttagctgatggtgacttgacaatcgtctttacatcaaggggatttcagccactggctgagcaatttggcgagcgatatgtatttgtcggtccttccattacagaaagagccggaaacaatgatttcccatttgatcagattgacaatgaaaacgtgctgtttatttcaatgggaaccatttttaataatcaaaagcagttttttaatcaatgccttgaagtttgtaaggactttgacggtaaagttgtgctttctatcggcaagcatattaaaacaagtgagttaaacgacattccggagaatttcattgtacgcccgtatgtccctcagcttgagatcttgaaaagagccagcttatttgtgacacacggcggaatgaacagcacaagtgaaggtttgtattttgaaaccccgctcgttgtcattccgatgggaggcgaccaatttgttgtcgcagatcaggtggaaaaagtcggcgcaggaaaagtgttaaaaaaagaagaattatctgaaagccttctgaaagagacgatacaagatgtaatgaataatcgttcgtatgctgaaaaggcaaaagaaattggacaatcactgaaagcggcaggcggctctaaaaaagcggccgatagcattcttgaagctgtaaaacaaaaaactcaatcagcaaatgcatagtgtaaaagcctgttcttatcgaaagaacaggctttttgccatttcataagaatgcagaggaagggatttgatacgccgatagagaattgattagaaaaatagacaagaaaggaggagaaactgcttcgttcatcaatagaaaaccatcatttttacccccgcttaaatagttccttagactttcgaaaaacatatcgtgcttatgtaaaatgttagatgtttatttgaaggtttaaaggtcgaacgatgctgaaaatgctgcgccaaatgtttgaaaagggtttaacttgctgaaaaattgacgataaaacagttgtgtgccatttttggaaacaaaatactagctgtttttacaaaaaaacagtttaggaggttgaatgaatgaaaaagaagattgtagccggcttggctgtttctgcagttgttgggtcgtcgatggccgcagcacccgcggaagcaaaaacgataaaagtaaaaagcggtgactctctttggaaactttcccgccagtatgatacgacaatatcagctctgaaatccgaaaacaaattgaaatcaacggtgctttatgtcggacaaagccttaaggttcctgaaagcagcaaaaaaagcacgacatccccatctaactcaagcaaaacatcaacatacacagttgcatatggtgattccctatggatgattgctaaaaatcataaaatgagtgtttctgagcttaaaagcttaaacagcctgagcagtgacctgattcgtccggggcaaaagcttaagatcaaagggacaagcagttcaagcggatcaaatggatcaaagaaaaacagcggttccaattcttcaggttcttcaaaaagtacatatacggtcaagcttggtgactcactgtggaaaatcgcaaacagcttaaatatgactgtagccgaattaaaaaccttaaatggcttaacatcagatacactttatcctaaacaggtgctcaaaataaaaggaagcagttcacctaagaacggaaacagcggttccaaaaagccgtcaaactccaatccctcaaaaacaacgacgtacaaggtaaaagcaggcgattcgctgtggaaaattgcaaatcggctcggagtcactgtccaaagcatccgtgataaaaacaatttatcatcggatgtgctgcaaatcgggcaggttctgactatttctggaacatcaaaatctaatccttcacatccgacaaagccaaaagataactcagggtcaaacattcaaataggctcgaagattgacagaatgatcacggaagcgaaaaaatatgtcggagtgccttaccgatggggcggaaacacgcctgccggttttgattgcagcggcttcatttattacctcattaataatgtatcatctatatcaagattgagtacggcaggatattggaatgtcatgcagaaggtcagccagccgtcagtcggagactttgtcttctttaccacttataaatccggcccatctcacatggggatttatctaggcggcggtgactttattcatgcaagctcatcgggcgtcgacatttccaatctcagcaattcttattggaaacagcggtacttgggcgcaagaagttatttttaaaaatgagtatgacaaaaagccttttataggcttttttgtttataccagacaatgattgaccacactgttagaaaaaacaagggggagacagtatgcaccgtctcttgctgttgatgatgctgacggcaatgggagttgccggatgcggacaaaaaaaaccttcagaccctcctaaccgggtgccggaaaaaaaagtggttgaaacgtcagcgtttggtcatcatgtccagctggtcaatcgtgaagggaaagcagtcggttttatagagatcaaagaatcagatgatgaaggcctcgatattcatatttccgcaaacagcctgcgtccaggtgcttctctcggttttcatatttatgagaaaggttcttgtgtcaggccggattttgaatcagcgggcggtccctttaatccactgaacaaagaacacggcttcaacaatccgatggggcatcatgccggagatctgccgaaccttgaagtcggtgctgatggaaaggtagatgtcattatgaatgcgcctgacacttcactgaaaaaaggaagtaaactaaatattctcgacgaggacggaagtgcatttattattcatgaacaagccgacgattatctgacaaacccaagcggcaattccggtgcgcgtattgtctgcggagcccttttgggaaataacgagaagcagtaatatcatccaggcccttttgtattgagcatacaggggcttttttagtatactcgttaatggaatatgaataggaaagggaatctgtctatgacaactcaactacagcacttaacattgccggaagatatacaacaaaagcttttatcatataaagagcagcctatttccccagagtttcaatcgcttataggaacatcaggctatgaggcggaggatgaagccattttatttgacgccattattgcattagccatggggaaaaatgtcctgctgaaagggcctacaggttcaggaaaaacaaagctggcagaaacattgtccagctattttcataaaccgatgcacagcgtcaactgttcagtcgacttggacgctgaggcattggtcggttataaaacgattgaaaatcaatctggccaggcaacaatcgagtttgtttcaggacctgttacaaaggcaatgaaggaaggccattttctttatatagatgaaatcaatatggcgaagccggaaacactgcctattttaaacggtgtattagattacagaaaaatgatgacaaatccgtttacaggcgaggtcatacgggctaaaagcggtttcggagtcattgcagccatcaatgaaggctatgtcggaactgttcctctgaatgaagcgttgaaaaaccgttttgtcatcattgatgtgccttatattaaaggcgagctgctgaaacaagtgctcatgtctcagtcagccttgaaagacgagaaattgattgacagatttatcacgctttcctctgacttgatcgttcaggccaataacggacaggtgtctgaagaagcggcatccatcagagctttaatcgatacatgtgatttagctgcttatattccgccgcgtcgtgccattgagcggggaattgtagaaaagcttgatgatgatcgggaaaaagcggctgtccgaaatattgcagaaactctgtttgaatgagggggctgcgatgaaatttatcaaatttaacgacagcacgattgattcatttttatttatgatgctgactgatttggccaaaacactcaccaagagtgaagcggtagaagtggagtatggcgttcagtcctattacaatccatttgaaaagaaaatctatatgagccacttttggaaagacagggcagctgaggacatggaagcgggtctgaaaagcgacgtctacctgcgttcagtcggaacaagatatagctcgctgcatgagtttgcgaactttttgaatgatatccatcgtcatcttacctttaaaagttttgccaagcagctctttatgctgcttgaagacattaggatcgaagaatgcatcaaacgtgagcgtccgggtacgaaacatgtatttgcgaagcgaaaagacatgtacagaaaacatttctcaacccagctgaccttaaatttggaacgaagcatttttaccgatgcgctcttttgcgcgatctatgtcaagctcacagcggaatcgccgctcgagacccttccatccatgcgtgaagatatcgatctgatgcgcccgtttattgagcagcagctcttgcgtgtgtatgaagcagattcgacacggcaggttctgaaaattgttgaggacctcatggacggacttgaagaggtgctcgataaagacatgttgaacacctacttctttttgcctgagcttgactacgcaaaagctgcagaacagccgttatttgaagaagagaaaaaagcgccgaagctgagtgatgacatcacgcttccaaaaaaatcagacggtgatgaggatatccatgaagaagaaatgccgacatggcaccgggaaacagaagcaccgtctaaaagcttccttcaatttgatattgaacacggcgcaaaatcagatttaggaaaagatgcttcaagggaaggcgacgatggagatcaggcccttggctctgttcaaggatcagccagacaaacgaaacggaaagactattccaagctggaagcgctggagtctcaaaaagaccagccgaacggagcgggtatggctgacggcaaagaaaataaatatgcatttccaatttataaagaaccgcagccggcaaccagtgaagaggagctttcttataaacagcaggcaaaaacgattgaatcgtatcaaaagcgtttgaaacaaatgattcaaaaaacgctggagcataaaaaaacattgccgagaacagatcttcatgccgggagactgaataataagcttcttcgctacttcactgagcgaaatccgcgcctattctacaaaaagcaagaaccatcttcagaaatagacgcagtttttacattgctggtcgattgttcagccagcatgttcgacaaaatggacgaaacaaaacgaggaatcgtgctgtttcacgaagcgttgaaatcggtagcggttccgcatcagattgtcgggttctgggaggacacaaatgatgcaaccgaaacaagccagccaaactatttcaatacggttattcccttccaatcatcattaagacaagagtctggaccggccattatgcagcttgagccagaagaagataaccgtgacgggtacgcaattaggcagatgacgaaaaaaatgctgcatcgcagcgaggcgcaaaagttcttaattgttttctcagatggagagccggccgcatttggctatgaacaaaatgggatcgtcgatacaagtgaggcggttatcgaagcccgaaaaagaggaatagaagtgataaatgtttttctctccaactcagaaatagaagaatcgcaaatgaagacgatccaggatatgtacggaaaattcagtatatttgtcccggatgttgatcagctaccggatgttttgtatccgctgctgaaaaaactgcttcataaaagcataggatagcccttaatcctatgctttttggcgtttgttttttcgaatgattaaattttttgttttttataaaggttttttactattttgtgaacaatcaaggtagaatcaaattgcaaacagtggtaaaatatcgttggaagcgtttttattacataattttggacacagcgttcgaaagttatttcaagatagtgaatcaatcacttgattatttaagttgggggtaatattcaaatgtttcaaaatagtatgaaacaacgaatgaattgggaagatttttacggtccgaacctcggctatgcgctggagctttacgatcagtatacccaggatccgaacagcattgacccggatttgaaggaaatgttcgacgagctcggtgctccgccaagcgatataaaagaggcctcgggaacaaaagaaaagggacgtgttacagccgatctgattcaaaagatcgcatccgcagtcagacttgcagaagatatccgaacctatggccatttgaacgcttccgtcaatccgctcagaaaggatgggaaaaagagcgaactttttccattatccgattacgggctaacagaagaggaaataaaagcaatacctgcgtctgtcatctgcaaagacgctcctaaaaacattacgaacggtttagaagccattcagtatttacgaaatacgtataaaagaaccatctcttttgaatttgaccatgtgcatgacttcaaagagcgcgagtggctgacaagaaagattgaatctggcgagctgttccagaagaactcagctgaaaaactgtcggctgtgctggaaagactgactgaagtagagggcttcgagcagtttttgcaccgcacattcgtagggcagaagcgcttttccattgagggtctggacgctcttgttccagtgcttgatgacattattgcacaatctgtcaaatcaggtacgacaagtgtcaacatcgggatggcgcacaggggacgcctgaatgtcttggcacatgtgctcggcaaaccgtatgaaatcatcttctctgaattccagcatgcgccgaacaaagatcttgtcccgtctgagggatcaattggaatcagctacggatggacaggggatgtcaaataccatttgggggcgaatcgggagcttcaagacgctgaaacaaaatcagcgcgcattacgttagcgaacaacccgagccacttggaatttatcaatccgattgttgaaggcagcacaagagcggcacaggaaacgcgaacacaaagcggatacccggtacaagatgaaacaaaatcgctggccattttaatccatggagacgctgcattccctggggaaggaattgtagctgaaacattgaatttaagctctttaaaagggtatcaagtaggcggtgcgattcatattatcgccaataacatgatcggattcacaacagaaagcgctgaatccagatcgacaaaatatgccagcgacctggccaagggttatgaaattccgattgttcacgtgaatgcggacgatcctgaagcttgtctttcagctgttaagtttgcggtcgaataccgaaaaacattcaacaaagattttctgattgatttgatcgggtacagacgctatggacacaacgaaatggatgaaccgtcaaccactcagccaatgctgtatgacgctgtcagaaagcatccgaccgtcaaacaaattttcgctgaaaagctggtaaaagaaggcgtgcttaccgaggaagttgttcaaaacatcgaaaaatcggtaacgaagcgcattgaagatgcatatcagaaagttccgtctaaaaaggaacacactgcctgtgaaattgaacttccagagcctgtatcaaacggtttcccagatgtggacacttcgattgattttgatgtgctccgcaagctgaatggcgaattgatcaactggccggagtcatttaatgttttcggcaagctaaagcgcattttagaaagacgcgccaaggcgttcgatgatgacagaaaagtggaatggtctttggcagaatcactcgcgtttgcttcaattttgaaagacggaacaccgattcgtttaacaggacaggattccgagcgcggaacgtttgcccaaagaaaccttgtgcttcatgacagtgagacgggcgaagaatttgtgccgcttcatcacttatctgactgcaacacatcatttgctgttcataacagcccgctgtctgaaggatcggttctcggttttgaatacggctataacgtgcattcaccggaaacgcttgttttgtgggaagcgcagtacggagattttgccaacgctgctcaagtgtattttgaccaatttatttctgccggacgcgcgaaatggggccaaaaatccggattagtcatgctgcttccgcacggttacgagggacaggggcctgagcactcaagcggaagaatcgagcgattcctgcagcttgcagcggaaaacaactggacggttgccaacctgacaagcgcggcacagtatttccatattttaagaagacaggctaaaatgctgcttcgtgaagaaatcagaccgctcgtcattatgacgccgaagagccttcttcgcaacccaaatacggtgtcggaagtgcaggagctcagcgaaagccgcttccagcctgtttatgaacagtcgggactttctcatgactatgaaaaagtaaccagacttgtattatccagcggtaaagtgtctatagacatcagtgatcattttaataagttagaagacggtaaagagtggcttcacattgcgagaatcgaacagctgtatccattcccggcaaaaggagtcaaagaattatttgcaaaacttccgaacctgaaagaaatcgtttgggtgcaggaagagccgcagaacatgggggcttggggttatatcagcccgtatttgacagagattgcaccagagggagtaagcgttcaatatattggacgaagaagacgatccagccctgcagagggagatccgacagttcataaaaaagaacaggaacgtattgtatctgatagcttgactcgcaaaaactaagggggaaatgaaaaaatggcggaaattaaggtacctgaattagcagaatcaatctcagaaggaacaatagcccaatggttaaagcagcctggtgactatgtagaacagggtgaatatctgcttgaactagaaacggataaagtgaatgttgaattgacagcagaagaatcgggtgtacttcaagaggtattgaaagattcgggtgataccgtccaggtcggagaaattatcggtacgatttcagaaggcgcgggtgaaagttctgcccctgctcctacagagaaagcagaaagcaaggaaagcgtaaaagaagagaaacaggctgaaccagctgcacaagaggtgagcgaggaagcacaatctgaagcaaaatcaagaacaattgcttctccgtcggcccgtaagctggcgagagaaaaaggaattgacctgtctcaagttccaactggagatccgcttggaagagtgcgcaagcaggatgtcgaagcgtacgaaaaaccggcatcaaaaccggctcctcagcaaaagcagcagcctcaggctcaaaaagcacagcaaagctttgacaaacctgttgaagtgcaaaaaatgtcacgccgcagacaaacgattgcaaaacgccttgtagaggtacagcaaacatcagcgatgctgaccacatttaatgaagtggacatgacggctgtcatgaatctcagaaaacgccgcaaagatcaattctttgagcaaaatgaagtgaagctcggctttatgtctttcttcacgaaagcggtcgtggctgcattgaaaaaatatccgctgttgaatgcagaaattcaaggcgatgagttgatcgttaaaaaattctacgatatcggaatcgctgttgctgctgatgaaggccttgtcgttccggttgtgcgggatgcggatcgcctgacatttgcaggaatcgaaaaagagatcggcgagcttgcgaaaaaagcaagaaacaataaattaacccttagcgagcttcagggaggctccttcacgattacaaacggagggactttcggttcattgatgtcaactccaattttaaacagcccgcaagtcggtatactgggcatgcataagattcagctgcgccctgtagccattgatgaagagcgtttcgaaaaccgtccgatgatgtatatcgctttatcttatgatcaccgaattgtagacggtaaagaagcggttggtttcctcgtgacaatcaaaaatttactggaagatcctgaacagcttttattagaaggataataaaaaagggtacatcactttatcgtgatgtaccttttttgatgcatatttaaagtgatagattgctgcttttggatccagcttgcttctttttcactttttttgaccaatatgttgcaagcatagaacctgaaaggttatgccacacactgaatattgcgcttggtacggcagatagcggtgagaaatgagccgtggcaagtgcagccccaagcccggagttttgcatgccgacttcgattgcaatcgctttttgagacgggtaatccatttttaaaagctttgcacaaagaaacccaagtaaataaccgataccgttatgcaggataacaactgaaaaaatgagcaaccccgattgaagcagattttcccgattgccgctgacgacagctgagacaatcgcaacgatgccaatgacagaaacaagcggaagggcatgtacggcttttgccacttgttttctgaaaaacattttgacaatcagacctgcaatgatcggaaataaaaccgcctgtaagattgaaataaacaaagaccccggcgagacaggaagccattctttggcaaacagcataatcaacaacggtgttacaacaggtgccaataaggtagaaattgtcgtaaccgcaacagaaagggcagtatttccttttgctaagaatgtcataacattagatgcagttcccccgggacagcagccgacaagaataacaccaactgcgatttcagctggaagatgaagcccaaatgcgaggccgaaagcaacgagcggcatgatcgtatactgagctattactccaataataacttgccaaggctttctgaccagctctttgaaatcatcggcttgcagtgtaaggcccatcccaaacatgataatgccaagaaaaatcgtaatataagaactgatccacataaataaagatgggaaagaaaatcccagcactgcaaaaacaatgacccatatgccaaaggtttgtcctgcaaaatgacttatttttctaatgatgtccataaaaacactcctaacacacttatcaagaacttcagcagaaattcttacaaatttcataacattctcttattataaataattttctgaataattcaatattagtttttggcagatgtctatagatatatgatgtaaactaattaaaatgttcttgactatataggaagatattcttacaatgaacctttataatggttagatcaaataggagtgatacggtgaaggaagcaaatcaatggtcttcgaagctcggctttattttagccgcggcaggatcagctatcgggcttggtgcgatatggaaattcccatatgttgccggaaccagcggaggaggcgcatttttacttatttttattttatttacggttttaatcggactgcctttattgttaggtgaatttatcataggcagaagaacacagaaagatgccgttcagtcctataaaacacttgctccaggaacgaagtggcattggatcggttatttaggcatggtgacgtgctttattcttctatctttctacagtgtcgtaggcggatggattttaatttatattataaaaggcttcactggcggtttatcacaaacatctggttttgatacgatatttgcgagtaccatttcaaatccttatttggctgtaggaggccagctgctctttatggtggtaacaattttagttgttgcaaaaggggtaagcagcggaattgaaaaagcaagccaagtattaatgccggcgctttttctattattcatcattttaatggtgcgttcggttacacttgatggtgcgatggaaggaatcaaatttttcctgatgcctgatttaactgcaattgatgccaataccattttatatgcaatgggacaatcctttttcttattaagtgtcggtgtatctgtcatggtaacgtatagcgcttatttagagaaacaggaaaatctggtacagtccgctgtatctgtaactgttatgaacatgcttgttgctgtaatggctggaattgcgatttttccagctgtcttttcattcggcctcaaaccagaccaaggcccggttctgttatttaacgtgctgccgactgtgtttaatcaaatgccgttcggaattatctttttattagcatttttacttctatttttatttgctgcattgacatctgctttttcaatgctggaaattttggtcgcagtactttcgaaaggcgatgtcaataagagaaaacgattcgcttggttaggcggaattgctatttttattgtcggtgtgccgtctgcattatcatacggtgtcttaagtgacgtctctatatttcatctgtctatttttgatgccgccgactatcttgtgagcaatattttaatgccgttaggtgcgttactgatttcgatttttgtcccgctaaaaataccgaaacaggatttgtttgacgagctgaaaagcggttctaatctcaaacgaaagtggtttgctgtttggctgctgctcattcgatatttatctcctgttgccattatcatcgtgtttttgcatgtggtagggattttttaaaacacgaagcccccggagaaaggggggctttttttaatagagcttccaaacgacttcttttgcctgctcaaaacgtttttcagcctcgcgccaatccacgacattccaccagtggtctacatagctggcccggtcatttttatattgcaaatagtaggcatgctcccatacgtcaagcggtaaaaggggaattacatcccattggctgaagagctggtgtttttctgccgttaaaatctccagccgtcctgatcgaggtgcccagaccagaatggcccagccgacgccttccacttttttagcggcttgggtaaaatgttctttaaaagcggaatagcttccaaatgaaaggtctatcatttggaacaatgcccctgtaggacgccgttttccgtttggatgcatagaaaaccaaaaaatactatgcaaataatggcccgctccatggaacgcaagctctctttcccaatgagtgattaagtcataattctttgtcgctctcgcttttttaagctctgattctgctttgttcaggccatcgacatagctttgatgatgttttgtatgatgaaggaccataatatcgcgtgaaatataaggttctaaggcggagtatttgtaaggaagctttggcagcacgtgtttccctatagggacataagcgcgtctttcacttgtatcatctgattctgtaatatcccgataaagggcagcggcctgtttataccaatcttcttctgttgtttggtcatcttccagagcctcaatcatctcgttgatttgatcttcaaactggtcaagctgacctcgcttttgaatctgatctttcagggcttcacaccaattgaacatttccgtttgataagattcacgtttcatttgctgtctccttttcaatagaatctaaatacttcccgacagccagcaaagagaatacatatggataactgtgatagcgaatataaaattgcttcggcaatccgatccctgctggatacgcgaggctatcgaagctatgcgaattgctgtcggtaaggtattgcatgcctttcacaactgacgggtgttcggaattttcatatgtgagcaaagcgtctaaagcccaggccgtttgtacaatggttcctctatgaagcggtacatatgttttgatttcggcgcttttgcaggattctccccagcttccgtcatcattttgtatggatttgagccaacgcagagccttttgtataccgggatgctttcggtcaaccccgcatgcatgcataccagtaagagcagcccaagtgccgtaaatgtagcaaacaccccatctgccgtaccaagacccattttgttcctgatgttcgaaaagccacttcactgcgcgttgaatatgttgatgtttttctgtgaagccaactttctcgcctaaaaagtgcagtacacgtccggtgaggtcggtggttgaagggtcaactgcagcgtcctcggcggattcaagcggcagaaggcggatcagtggatggttcacgtttttttcgaaagcagaaaatccgccgtcattgttttgcatcgataaaagccaagatacccctcgctcccatgctgcaggagaatgattgcggggaatcgcctttaaaacggctgcagtgtcgtcacagtcagggttatttgtattaatgtttgaaaacccccagccgccaggaactgaatttggatttttgacagaccaatctgctattttggtatgctggcgttctagcaaaaagtcggctgcttttgtaacggagctatccgtttcagtcacaccatttttttgaagggcatagctgattagagctgtatcccaaacagttgaagtagagttttccagataaggaatcccgttgcatttagtcaccagtgatttaatgccggtaatcgccctcctgataataggagaatagcgtgacacaccaagtgacagaaggctgtaaaccataaatatggttgcgctcgcatagctgtataatgttccgtctttttcaatccggtccagcatatacgttttagctgtctgtaggcccagctgctgaaaagcaaatggtgcatgaaaaatgcgtttccaatgtgacaaaatagacgtgagatctctttcttcgaaagcatcagaccgaagccaagtgaaaggattttttgtcatgtgcggatcgagatggcgaagagatgaaatattgcggttaataaggacaaatcgctgattgagtgttacagccattggagcaaaatgaatacgggcatatgagctgaactgatagaaatgaatcggcaatgttggggggagcgccatgagtgataatggtaaatacaaagcaggccaaggataaagcccgttcgcggcaagcatccattttgtcataaaatgaacatgtctcaaaccgccatgtgagatgataaattgttcagctttcttcatgtgcggctcagatctgtgaaaacatcctgaagccagcatcccgacatatccttggacggtagccgttagatttccgcgcgtttcatcgggatagttgataaatgtgccgtctggctgctgttttgcatgaatgccggctgcaagggatgatatcagttctttttcattttcgccttcatctagtgaggtaaggagcaaaataaaaaaggaatttgtcatgattggtccttcaaagcaaaatgtccatgaaccatcagcattttgcctgtctcttaactcggtaatggttttcttttgaaaacgcctcactttctcctgaagtgtgcccatcacgctcaactccttcagaagcatatatattcagcgtcttttactgccattacagaaagaaaaaaactgctggcaggcagcagttttttaaacatacatgttagtcttcaaggtttatccatacacttttgacttctgtgtaattatccaaggcatatgatcccatttctcgtccgagtcctgactgtttataaccgccaaatggagacgccgcgtcaaacacattatagcagttcacccaaacggttccggcttgaagtcggtccgcgatataatgagcctgcttgacgttctctgtccatagtccggccgcaagcccatattctgaatggtttgcccgttcaataacttcatcgacagtttcgtacggaattgcagtcagcacgggtccgaaaatttcttcttttgcgatggtcatttcgtcttcaacattcgcaaacacagtcggtgcgacaaaatatcctgcttcaaaaggacagcttccgccggtcactacttttgctccttcatcttttcctttttgaatataggaaagaacgcgctcatgctgttccttgcttacgagaggcccgatttgagtatctttatgaagtcccgctccttggcggagtgactcagcataggacgccatttcatcaacaacttcatcatattggtctttatgaatgaagacacgtgagcccgcacagcagacttggccctggttaaacatcacaccgtttaaagcgcccgggatggcttttttcaaattagcatccggcagaagaatattaggcgattttccgcccagctccaatgtaacacgcttaatgcttttcgctgcggtggacatgattttctttccgatttcagtggaaccggtaaaggcaattttatcaaccgcttcgtggttcgtcagcgcttctcccgcatcttcaccgaatcctgggatgatgttgattacaccggcagggaaaccggcttggtcaattaattctgccaaataaagagctgaaagcggtgtttgttcagccggtttgaggacgattgtacagcctgttgcaagtgccgcgcccattttccacatcgccatcaggagcgggaaattccatggaatgatctggccgacgacaccgacaggctcatgacgcgtataattaaagtaagcgccggaaaccggaatcgtctgtcctgttatttttgtacaccagccggcgtaatagcgcatatgctcaatagccagcggaatatctccattagtcgtttcattgatcggtttcccattatcaagtgtttcaagctgagcaagctcagttttatgctcttccattaagtccgccagcttatacatcagtctgcttctcgaagctggagacattgttctccattcaccttggtcaaaggctttccgggcagctttaaccgctttgtccacatccgcagcctgggcttcatacagcgtcatcaaggtttcgccggtcgccgggtttggagtgtcaaaggttgcccctgaggcactcggaacaaactttccgtcaatataaagcttctttgttccctgcaaaaatgtctccagccttttcgtcacttgcatcgttaaagaactcatccgtaacaaacctccagtcattttttatggtctgttctgagattcttggtgatagcacattgattcttgggttgaatagcagaaataagctgtgatagttgcttcaaacgtaagcgtatacaaacattctataatagaaatcaaggcaaaatcaatgaataaccgatattgcaatttacaaaagaaaaaagctacaataagcttatagataagaaaaggagatttcatcatgattcataaaaattggcttgaaaaagaaacaattaaaaaagtaaagtgtgtgcagacaaacgcaaaaaaatatatcgtaaaccgcgttttaacgccgggaaaagaatatgaagtaaaaaatgaaacagaggagtttctctttgtggtcgacaatacgaataaagtcggcggctattataaagaatacttcgaagagatgtaatgtttccttgaagcatcagacagattttgttaaaacatcgatacataatccgcagctcagctgcggtttttttgtggttaaaacaggaaatataaaacaaaattaaaaaaatcattaaaaaccacttttttataaaaacattgctgaatattgaaacttttttctctatatgtgcgtattacttgatgacaacagcttaaaagccaaaaaacaaatcaaaaatttgaaaaatgtaatctgttcgtaatggtttaaatgtcttctatgtcgtattcttatatagggataaaggacttatttttatgtagtgaatgataaaacaaatagataaatgcagaaagaggggttcttcattgggtattttttctgttagcagatcaacggacgcaaagaagcttgaggctttgctcgttgaaggggaaagaatagaatcgatttataagctccgagtggaccaaatttgctttacaaataagcggatcattttctttgacaataaaatgttttccaaaaagaaggttcgtgtatttcttccatataaaacaattgaaagctttgccatccaagaagcgggaatgtttgatccggacactgggcttttattgatgacaagaagcaaaacgttcgaattagaatttgcgaaagacaccgatttaagcgaggttcaggcagtgctgacaaagcatttgtgcagctgaatatttgatgagccagccgttcaaaaaatggttaggctttttttatatatataaaaaagaacagggcatgtgcgccctgttcttattacaccacactgtttttcgctgagttcgaatcaacaagatctgcatctaatacatttgaaatcggtacgacaagaggagtaaagtcgccattttcttctccaaacccttgatttattttagctgataaaaagtaatcgacctgctgatacggaccgagtgttaaagaggaacctcgatccatcgtattgattttaaatccgccgacatttacgacggagggtgaaaagaacatctcatcacttccttttgattgaggagttaaccgcttcactttcaaaagaggccggagaatcaatttggtctctgtcatccacatggcttctcgtgcccataaatccgctcgcatctccaaaattctgtccgtagccttgattttttttatctgaattttgccattctgccaataaattttgtcctacgttaaccgctgaagcattttcaaaggaattaattttcagcatgaaaatattaatattgatatacggagttggttgaaccacaggcaaacctcctttctatagttgtatgctggcggttataaagtatgttaagacagggggcttcaaatggatttcgaaaagatgaagcagtggatggaattcgcacagcagatgtacggcggtgacttttggaaacaggtatttgatgaagaccaaaaaaccccttttatgacaaatggccaatctccgtttccgtttgcgcagcaagatcagcgagggaaaggagatgcttcatttccgagcatggatattgtagataccgttgcggaagtgcagtttttaatttatcttccaggctaccgtaaacaagacgttcacatattatcgtacggagattatttagtggtgaaggggcagcgcttttcctattttaatgaacaggactttcgccaaaaagaagggaaatacggaagttttgaaaagaaaattccgctttccgatcatcttcatggaaagatgaatgccatttttaaagacggaatcctatacatcaccattcaaaaagacgaaggtcaagcgaaaaccattgttattgatgattgattttcatactgagtgcatctgccccatcacggtcatcaattgattcaatcggaatgaccataacaataacatctgcattttgttccccaaaaccgttatttcttttgatagcagagcacctgttccttaactccgcagaaccaaaggtaagggatgagccggtgcctatcgagttagtcttgagatgagaaatattgatgttagttggaagcatgaaaacctctcctttctatgggatatacctcattatatatgtagacgaaagaggagtatgcaaagggtcgtgatgtcatgaaaaaaatgttccggtcgctgatcaggcattgcttgaaaccagaacttgacaaactgcgtgaatgtgaagaaagactctcagtgattgagaaacaaaaacaaagcagcaaacaagagtctgaagaaacctatatacatattgaaacgctgaatgtcgaaaaggttgactatcatcttgaattcggcgagctgaccattgatgaactgagcggcagattaaatataggcgcaacctattatataccgccagaagagaaggacaaaaagtgccaacgaaaacccgaagcaccatcgacgccagcggtcacgatccgttcaaaaaggcagtagctcatctttccatcgatgtttccatgtttgacagaaggcaaaacgggaaacaggatagaaaggagaggatatacatggcactgacaaaagaacaaacacagcatctctatcataaattgctcgatatgcaaaaagaattgtctggcgagaaaaaggaaacagaatcaatgacggaagaagtgggggagctttccaacggggttgacaaccatatggcagaccacgggacgctcgtcacagaccggatgacagaccaaacagtgaaagagattgaccgggagctgttagaggaggtcaaccgtgcattacaaaagatgaaagacggaacttacggcgtgtgtgaaaaaaccggccaagagattccttacgaaagacttgaagctgttccttatgcaagaatgacagttgaggcccaagctgatgtggaggatgatctggagacagatgctccttcttatgaaagagagtttcatgaacaggtaaaagacttatccaacaaagaaacaattgatcaaaaaggctcgcagacgtatgaaatcttggatcgtgaacaagattcgaagtaaaaatggcaagcaagtacaccgatattagatgtacttgcttttttttttgaaaaaaaatctcatattcaaaataaagtgattgactttgcgtaaaaaagaaagtaacatactatttgtaagtaaatataaaaagtttaccgggaggaatacaaatgtctacagttttatttgtaaaatcaagcgaccgtacagctgaagaaggcgtttcaactaaactttacgaagctttcttagctgcttataaagaaaacaaccctaatgatgaagtggttgaattagatcttcataaggaaaaccttccttaccttggcagagatatgattaacggaacatttaaagcaggtcaaggaatggaaatgacagaagatgagaaaaaacaagcagcaattgctgacaaatatctgaaccagtttgtaaaagctgacaaagttgttttcgcattcccgctttggaacttcacagtgccagcagtgcttcatacttatgttgattatctgtctcgcgcaggcgttacattcaaatacacacaagaaggaccagtcggtttaatgggcggcaaaaaagttgcgcttcttaacgctcgcggcggtgtctactcagaaggaccaatggctgcacttgaaatgtcattaaacttcatgaaaacagttcttggtttctggggtgttcaagacttgcacacagttgtcatcgaaggacataacgcagcacctgatcaagcgcaagaaatcgttcaaaaaggtttacaagaagcaaaagatcttgctgcaaaattctaataaagccaagactcctatcgttacaaataggagtctttttgtatatacacattaatatagaagaaaataatcattcgcttttagcaataaaggctattttttttattgtaatatattttttgtttgtcgaattgtcaggtattttggagaaaaaacagttttattcactggaaaaagtttttctaaacaattgttctgacctcttgattaaaagcgcctgatggtgtactatattaaagaagctactttgtgcgtattgttaattaagttttaacctttaagctgtaatagggagttttatatcgaagccggaatgtcatgcctccattgcagaggacgacaggaacgtttctgcaaacacccactttgaggagtggtggtttaaaactttcttacttgcatacggcaagacgtagcgaaagccatttccttttcggaaatggctttttattttatctaaaaaggtttggtatagtgaatattccatttttgtgtgaaagaaatgaaggccgcttttttatgatatgatgggagaaattcaaggaaaagcgaggtttacacgttatgttacatagagcccaatcccttctggctcattattttggttatgagaagtttcggagcggccaagatgaagcgatccgcttggtgacggaagcgaggcaaaatacggcctgcattatgccgacgggaggcggcaaatcgatttgctatcaaattccggcattaatgtttgaagggacgacgatcgtcatatcaccgttgatttccttgatgaaggatcaagttgatgcgttagaagaagcggggattaacgccgcctacattaacagcacacaatccaatcaggaaatatatgagaggctgaacgaactcaaagaaggggcttataagcttttttacattacaccagagcgactaacgtccacagagtttatccggattttgcagggcatagatgttcctttggtcgcaatagacgaggcgcactgtatttctcaatggggccatgatttcaggccaagctacaggaatattgaaatcttgttccgtgaattacacgacaagcctgtcatcatggcgttaacagcaacagccacacccgaggttcatgatgatatttgcaaacagctgcatattcaaaaagaaaacacggtatataccggattttcccgagagaatttaacctttaaagtagtaaaaggagaaaataaagatcggtttatagacgaatatgtgcaaaacaacaggcatgaagcaggaattgtctataccgcgaccagaaaagaagctgatcggatatatgagagattgaaacgaaatcaagtcagggcaggtcggtatcacggaggtttggctgatgatgtgagaaaagagcagcaggaaaggtttcttaatgatgagcttcaagtgatggtggcaacctctgcttttggaatgggtattgataaatcaaatatcagatttgttctgcatgcacaaattccgaaagatatggaaagctattatcaagaggcaggacgagctggacgggacggtcttgccagtgaatgtgttctcctgttttcaccgcaggatattatggtacagcgcttcttaattgagcaatcagaacatgaagagaaacaaaagcaggatttaaaaaagctgagacaaatggtcgactactgccatacggaagattgtctgcagcgttttatccttatgtatttcggagaaaaggagcctgatgcgtgcggacagtgcggaaactgtaccgatacaagagcggcccatgacgtgacgcgggaggcgcaaatggtcttatcttgtatcattcgcatgaaagaacggtttggcaagacgatggttgcacaggtgcttgccggctccaaaaataaaaaagttcttgaaaacggcttttccgacctttcaacatacgggatattaaaacaccaatccgttggcgaaatcagtgattttatcgaatttcttatttctgacgacttcatcaggatgtccgacggaacgtttccgactctttttgtcagcagtaaaggaaggaatgtgctgaaaggagaattatcagtagcgagaaaagaagcgttaaaagcggcagcgattactgaaaatgacgagctatttgaacgattgcgcatggttcggaaagaaattgcggctgagcagggtgttccgccatttgttgttttctctgaccaaacgttaaaagaaatgtcaggaaaacagcccgtaaatgatgatgaacttttgtctataaaaggagtcggagaacaaaaaagagcaaaatacggccggctttttttacaagaaatacaagcttatgcaaggatgacagactaaaaaaacagaaaaacaatctttttttctataaaaaacacattttattttctctgtttcgcctcaaaataaaaagacctgcgaagcctattatatcaagggttcagcaagtctttccatcagagagaaatccttcatgtaaaggaactgtaatctaaatcatatctttttgttattgatttgacatttacgtgtgttacgatatcacctgttagccgccaataaaaagctaacaagggaggatttacttatgaagaagacgattatgtcctttgtggcagttgctgcactttcaacaactgcattcggagctcacgcttctgcaaaagaaattacggtgcaaaagggtgatacgctctggggaatctctcagaaaaatggagtgaacctaaaggacttaaaagaatggaacaagttaacttctgataaaatcattgcaggagaaaaactgaccatttcttcagaagaaacaaccacgactgggcaatatacaattaaagcgggagatacgctttctaagattgctcaaaaattcggcacgacagtcaacaacctgaaagtttggaataacttaagctctgacatgatctatgctggatcaactctttcagtaaaaggtcaggcaacagcagcaaacacagctactgagaatgcgcaaacaaacgcacctcaagctgcgccaaaacaagaggctgtgcaaaaagagcaacctaaacaagaagctgtacaacagcaacctaaacaagaaacaaaggctgaggcagaaacttctgttaacacagaggagaaggctgttcaatcaaatacaaataatcaagaagcttcaaaagaactaacagttactgctactgcttacactgctaacgacggcggcatttccggcgttacagctacaggcattgacttaaataagaacccgaatgcgaaagttattgcggttgatcctaatgtaattccgctaggttctaaagtctatgttgaaggctacggggaagcaacagcagcagacactggcggcgctattaaaggaaataaaatcgacgtatttgtaccaagtaaaagtgatgcttctaattggggcgtcaaaactgtaagtgttaaagtcttaaactaataatatagattgtgataaaagacatgagcttttggcttgtgtcttttttttgttctgcttagagctgtttatatcatatgctgataaaagaaagtggtcccgtttttctctttatgtgcgattcaggggctctcgggttaaaagattggttccacattacagagacattcggcatcatgacatttatagctggttgttactatctttgatcagcgaaacgagctggtgttgtatcttttttggcagataataagcagttggatgtagcagatgccatttacggaatcggattgatttcagacggttttttattgtgatattaggctcttgcagttgggcatggcagcttcgggagcgaagtggcacaactttgtcatactgaaaatacaaaataatcaatatcagaaattctgctgatgtgcaatggccgaccattttaacagggatatcattcaatccagtcttttattgggctgttaaccaagcaatcgttcagcgggcgtaggagcgaggatatggatcaatttaattctggttgcgacgaggttctcaaacgggaatttcaggttaacaaaaaggatcctggcagatgccaagatccttttttatttaaaccagcctttttcttttgaccgggtaatggcttcaattcgatttttcacttcaagcttttctagaatcattgagatataattccgcaccgtcccgcttttgatgctgagttcctgagcgatttcttttgtgtttttaccgtcagccacaagttcgagcacttctttttctctatctgtaagagggttagcttcgctgtataagtcctccatcagctcaggtgcatagatgcgttttccgttcatgacgctacggatggcgttggccagctcttcactcggactgtcttttaacaaatagcctttaacgccagctttaatagctctctgaaagtaaccgggtctggcgaaggtggttaagatgataattttgcagcctgtatcttttagctcctcagcagcttcaagccctgtttttccgggcatttcaatgtccataatacatacatcaggctggcgttttttgacaaaatcaacagcatcttggccggttgtacctttgcctacgacttccatatcgtcttcgaggtttagaagtgatcctaaagcgcccagcagcatttgctgatcttctgcaataaatatactaatcatataagccatcctttatgtttattttgaattattaggaattgccatggtaagcttggtcccgttttcggtatcgatgtgaaggcttccgtttgcaaactcaagccgttctctcatcccgagtaagccatgtccttttgaaaaggaattttcttctcctttgaatgttccatcgtcagacactgttatcacaacttccttccagagctgctgaatgtcaactcggcaagttttagcctggctgtgtttgacgacatttgtgacagcttcctttaagcacatgctcaaaatgttttcattcagcaatgagatattttcaggccatttctcttcttcatagataaacataatgtcagctgcttcgagaatttgtttgatgttgatcaattcatccttgagccgtatgcccttcatagaggaaacgatttttcttacttcatttaaagaagttcgcgctgtttgctgaacacttttcagttcacgagctgcttgttcgggatctttgtatatcaattttcttgctaagtcgctttttaaaccgataagagaaagcttttgcccaagcgtatcatggagatcgcgggcaattcgctgacgttcttctaattttaccagttctgcaatccgttcatttgcatcctcgagcttttcttcaagccgttcgcgctccttgcggcttcttatactaaagggcaataaaattgcgctgatgagggttatgacgacaaaaggaatttgtgtcagaaagaattccttctttaatacgagactgaaattggctgcgacggctgcgcttattaaatggacataatataaaatatgaaaagggacgcgttccttaatgtttcctataaaatacgcgataaaaaaagcaaaataaatataactgaacagagtaatggaggcggttgaaatgccaattaataaaaatccccacaaataaatggtccagccttttgagacaaaagcaaatcgatataccgaaaaaaataaaagcgtcaaaatgatgccgacaataataacaaatgtagatgatgatttccatataaagtagaaggggaggatgaaaaatatcgtccatatatagggcgtaattccgtttagtttttgaaatgtaaaatgatttttaatcatgatcttacctcattttcagcttttcatcttacttgtaactttatcattgtgaaagccagaatgcaccctcaaacaataaaaggaagccttctagtatattagaagacctcctttatcatcaggcattcttccgcagcttctgtttttctggtgaatcaggcggaaggcttacagctatatgttttatagcccgaaatgacacaaactgtttgttatcttcatcccatagacggaacgcaagtgattgcaggcttgtttttaaggtgattgtcggtacgttttttaatggttcgtgatgttcatgagcaacttcaagcttatagttaggcacctttggactcaaatgatgaacgtggtggtaaccaatattgcctgttagccattgaagcagtttcgggagtttataaaatgaactgccttcaacagcagcctgaacgtagctccagttttcatccgcttcaaaataagaatcttcaaaggtatgctgcacataaaacagccaaacaccgattgaacctgaaatcagaaatatcgggccttgcaccagtaaaaacgattgccagccaaagatcagacagcaagcagcagccaacgcgacaattgccagattcgtaaggtatgtgtttacacgttccttgcgtcttgctccttttttgttaaaacggttcgtgatcagaaaaacataaatcggtccgagaataaacatgataaacgggtttctataaagtctgtatgcaagctttgttcgtctggatgcagctttatattcgtttactgttaacatccagatgtctcctgttccgcgtttatccagattgctgctagttgcatgatgaatcgaatggctgtgctgccattgaagatacgggaataaagtcaggacacctgtcagaaaaccgagaatgtggttatagcgtttttgtttgaaaaaagattgatggcagcagtcatggaagatgataaaaattcttgtcagaaaacctgcggcaatcaccgttaatgctaacgtaagaagataggagacatcgaggctgagataagcaagaaaccacaggccgaagaatggaataaacgtgtttaaaagctgaatcaggctgttttttgtttcaggctgagcaaatgcagcgacttgctttgtcagctgtttttgcttatgtgcaatggtttgttcagtcatagtaagtatcctctcattgtgtgtctcggttcagtatacgctaatgagagaagtcttttgtagtagcacacatcatgcctcctatatgacatttgtcatgtctcgtgcggcatgcataaccgattgcgctaaaaaagcttgtaaaaaaatttacaagctgattaatgtttatcaatccatattcgtgatgtacccgaaatagcttcaatcctgcatgttcctcctatagggaacgtggcaattggcgaggtatgtccggcatttatatttgcgatgatcgggatgctggataattctttttttgtttcgatcatggcttttacaagatccattgatacgtttgatgctttctgaaatctgccgatcaaaatcgcctttacatgtgaaaaagcggggaggtggatgagtgattgcagatcgcggtcaaacatatggatgtctgacatataatcatcttcaatcaataaaatagtatgttctgtttcgggaaaatactccgttccctgcagcaaattaagcgtgcataagtttccgccaattaaagtaccttccgcataaccttcttggattacaacagggccgttattaggataaaaacgcctgttttcttgatccaaaaaccagcggtcatcgctccactcacttgaaggaagaatttcaaacgggtcgtccgaagcgcagcaagaaagaaaatactcttgtgtataatcaagcccttttttcattgcaaatgttgagaagtgggggcctgaatacgtaacaagacccgtttttcgataaattgcgttgcaaagagcggttatatcggaatagccgcacagaatttttggatgtcgtttgattttctcgtaatcaagataacgcagcagctgatttgaattaaaccctccgagtgtcgttaaaatcgctttgacgcctggatcaaaaaaggcagcgtgcagatcatggactcttgactcgatagaggatgaatcaaattcattacattcatttgcgtgttcagcgatggttacccgataacctaagcgttctaacgccgtttttgcttggatttttgcttcatttgataatatagacatgctggtcgcgggagacacgatccggatttcgtctccctttttcagttttgaggcgtacatagaaccctccatcaatggttttttaccattacagcatatattggctctttcttccagacttttttacaaatcaacccacttaatgctgccggattgggtatcattatcgatacatactttgaattgatgtttttcataaaagtgaatcagccggtctacatgattccaatcccgtttggcgatgtctccggtgactttcggtatattgtggtctcttgctatatcttttaaatatttcatgcaaatggaaccaaacccgtgattcggagggccttttatatcgcctatatgaatggcatcgtccttgtaagacgctacaagtgaaaaacagccttttcctcggtaagccgttttacaatcagttagcataattttgcatgtttggccatcatcaatcgaggaaacaatcatccactcatcatgtttcgattgatcaataccaagcactttggcatctttagataaatccttcatattctcctgcatgcgataaatttgaaattctaaatcatttaattcttcttcaagctcttgacgatttttttctttaatagtaaacaagatcaaactcctttcaaaaatcagcttagaaacacagttaccaattgtattagaagagaggcgtattgtaaacaacaattccattattactagaaattagcggaaagtcaggtttgatcgtttttaagagaggaaaaagaaaactaacctgtgaaaaaggaggaatcggaatggcgattgattcattgattaacaaattacagtatgtccaattggaaccgccggataaaattctctctctgtatctcaatacagacatgagagatccagagcagcaggggggagaatggaagattgccctaaagtcaggattcagccgattaaaagagtatttggcagctagtgatccagaggaggaaacgtgtctggatggaatcagggctaaaatgaatcaatacttgaatgcaatgggaaaagacatgccccgcagtctcgtgttttttgtttccgacagcggcatatgggaacctattaagcttcaagtccctgtagatacaagattttactgggaagaaacagctgtcctggatcagctaaagggtttgcgccaggcatacccaagtacggcgtttattttaactcagcagcatgaagtgaaaattattgaaactgttttaggaaaaattgaggcggtggagcgttatgagtatgatatgatcaatgagtcttggaagaatagccattccgctgtagacaaagcgccaccagttgaagagaatcggatgagggaacatgtaacagagaaccaatcaagactgtataagcggctggctgccagccttgatcaaaaagctgccgcgaaaagatgggaacgaatggttattgccggggataaagaaacggccgatatcttggatcagcatatgaataaacccattcattcgaaaattcaaaagaacctgctgaatgaaaatgaacataaggtcattgaacatttgataaaagaggcgtaaacctaacaggccggggctaatagcctccggcctttgaagtgtgtctaatttctgacgaagcaatcgaaaccgttgacatcttctttgaatttgcatacgatttggatagccagtacaaattaggagaggtcaccaaatgaaccaaacagaaaataaaccgaaaaattacacggggattgtccttacgctgacagttctgattaacggtttaatcgcagtgctgttttttatgcctaaattagatcagttcagccatgcgaatattcacattttgccaatgctgaatgcgatattcaacagctttacgtttatcttcttattggccgcgctgattatgattaaacagaaaaatatcaaagctcacaaacgctttattttggccgcattcacaacaacattactatttttgatttgctatgtgacgtaccactcgattgcggaaaacacgctctatggcggagaaggtattatgcgcccgatttatttctttattttaattacacatatctgcctttctgcaattattgtgccgcttgcgctgtttacgctgatcagaggcttcagcatgcaggtagagcgccacaaaaaaattgcgagatggacaatgcctctatggctgtatgtaagccttacaggcgttattgtatatttgatgatttcaccgtattattaaaagccatactcagtatggctttttttacatgtaaacatggcaaaagcccaaattcatttttgggcttttgtcagtaaattgatagactcttattcatgagccttggattccatggtttcaagtgttgcaacctgcaaagattcttcaacagtttttgttttttcttttactttttctgcatacgtataatcaccgtagcaatacggatagcggaaatttttcgcatttcccccgcaagtatacagatcaggattttttttgacttgctgctcggagtattgttttgccaattcctcagtatgcgttcctccatgttcagctacaaaatcaatgtaacctgcccccatgttgtagctttgaataatggtatccaaatccacgcctttttccttaccggtcttgtacatgagggtaaattgcttgatgccttgtttaacactgagttgagggtctgttatctcattgcgttttaaccccagagattcagaggactgcatgggatcattgccttttccttttgactcctgatacatcatgcctaatatgagtgatgtataattagagagtccttggctttcaagctcttcttccaccaaaggtttgtaatcggttaaacgttccaaaacaatcgttttcgtatcgatcggaagttttttgattaaatcccggttaaaaaaaagcaggaccaataaaaaagaggcgatgacaaagacaaaaatcatcataaaacccgcagcagcgaaacagccttttctctttttcttcactgtgtttcaccctcaatgtttggagcagtatgaccttttttattatgacataagacggtatatcagaccaagtaaaaacctgatttgaaacataaatttaaactatgagattgaaatggaatacaagcaggctggtttgcactcaagcgcatttgttataagataaaactatgaataaagaaaggtgatacatatgactgaatttagagaaacggaacaatcggctgctgatctggacgaggagacgttgtttctagtcgcgcaaacattcaaagcgctttcagatcctacccgaatcagaattctccatttattgtcccagggtgagcatgcagtaaacggaattgcagaaaagctgaatttactgcaatccaccgtgtcccaccagcttagatttttgaaaaatctccggcttgtcaaatcgcgcagagaaggaacatcgatttattactctcccgaggatgaacatgttttagatgttcttcagcaaatgatccatcatacacagcatgattgaaaaagacatccttgcttaactcgctgctagcgggcaaggatgtctttttctttattgtgtccgtgctgttcgagttcgtttctgctgagcttgatgacaaaagaagaaaaaccgatataataaacggctatcagaaaacagacgccaattgtcagagggtccgttccgattgactgactgtatgatccaaggcggtttagatcaggcgaggtaagataaagctctgtcactcgatatagaaatcttgacaggaataaggttaagagaatcatttctacccaaatatgagtccgaaaatagatctttcctctgcgtttttcaaaggagatgtttttcttagcgaaaaagacaaggagccatccgccaagaatgcccaaaatgagatatccatataaaaaagggtgaatggcgctgaagattgaaaggccaaaagcaaacagcgagaaaagaatgacgcgagtgaacagccagcggggcttcagcggctggtatccgatggaccttttaatttttttatacagaaaaaagatgatgatcatggcaggataaacgctctgaaatgtaagatgcatgatgtgaaatcccctccgttgagaagtgtatgcttatccggttggaaatagtagctgaaataaaatactgaacacaaaaaagaaggggaaacccctgttttcatagcatatgcgaggtgtattccgccgcataatagatatgcccaagctttatcaaaatgttatgattgttttgttggaaaatacaagaagaaaaggtgcgcagaatgaaactggaacgtttgttagcgatggttgtgttattgatcagcaaaaaacaagtgcaggctgcagagcttgctgagctgtttgaagtatctgtcagaacaatttaccgtgatattgagacgatcaatagggctggtattccgattgtgacctcacagggttccgggggcggaattggcatcatggaaacgtatcggcttgaaagagagtggctgaaggaggaggaattgtttgcaattgcttccgctttgcagagcgtttcatctatgtatgaacccgtttctcacagcacagcctatcaaaaaatcaaacaccttatacctgagcaatctgctcaagcatttaagcaccaaacagaaaaatggtttattgacatgacggcttggggccatactgaggatcaaaagacgctgcgcgagaaaatcagcgctgccatcgatcgattgtcaacgatatcttttacatatacaagcgcaagcggggaaacactacttcgggaaactgaaccttatacattggtttgcaaggcggggcactggtatttatatgcctactgcctggtaagaaatgattttcgcttttttaaactgaaccggatgaaagatctggccatcttacatcagacatttatcagaaaagacattcagctggacactttgccatgggataagagttggtaccaaaaggaccgtttaactgaattggttattcttgttcagccgtcagcacgtcagcgtataggtgaatggttcggatatgatgtccttcactgttgtgaggaagatgaaatctgccaggcggtgatttcacttccagaagatcaatggctgatcggttttttgctccagttcggaaaggatattgaggttctgcagcctcttcatataagggataaagtaaaagaaaccattcatcacatgcaaaaaatatatgaaacctgacacactgctgtcaggtttctttgtctataatcttaaaaaaaggaggagatcgtatgggcttttcacatataacacacttagacctgaaacgatttgccggactatcacaacggacaagcaacgcactggaaatgacggaagaaaggaggattccggcactgtgggatcaattctggaagcaggatatgagcgctcttttatcacaggctgaaaaagacaagagcattattgccttatattcgaattatgaacaagagacgaatgggttttatacgttttcagtcggaacgtttcaggaatacgacgacattcttccgggaccatatgaaaatattgatttgccggcttccgcttacgccgttttcacttccagaatcggtcctattgaagagattgtgcttgaaacgtggaaggaaatttggacttgggataagcggcatctgcgcacgtttacaggtgactttgagatgtatgatcaaaatgccgcagtgccacagcgagcacaagttaacatttatgtagcgataaaaaaataataaactcttgaaaaactaatggtgttagttaataataaaactaacaccattagtttttgttaggaggaataaaaagatgagaattactcagtaccaaacggtttggcagctgactttttttccagcattgtttccggttaattgctatttagtagaggaagaaaacgaagtcacccttattgatgccgcactgccaggcagctataaagggattattcaagctgtgaatcagcttggaaaaccgcttcagcatattttactgactcatgcacatggggaccatgtcggatcactggatacattggcacaaacatttccgcatgcaaaggtcatgatctcggaacgggattcattcttgctccaaggtgacacatctttgcggcaagatgagccgcagacgcctataaaaggaggtattccgaaacacatacaaacaaagcctcaccaactgctgacgggcggtgaaacaattggttctctgcttgccattccaacaccgggccatacaccgggcagcatgtcatttcttgatacaagaaacggcactttaatagcaggagatgcgtttcagttgcgcggaggaatcgctgtatcaggtcagataaaatgggcgtttccttttcccgctttcgccacatggaataaggaggaggccatcaaaagtgcacaattgctcgcagataaggcgccttcctgtctcgctgtcggacatggaaaattcctgcgatcaccttcagagcggatgagacaggcgatccaaaaagcaaagaaaggatgatgagcatgtcaccgagaataggtttgacccaaaaaatgattgtagacgctgcagcagagattgccgatcaggaaggggtaaatggtgtctcacttgccgcactttctaaaaaaatgaatgttcgccccccgtcattgtataaccatatcaacgggctgcaagcgatcagagcagaacttgctgtcagaggactgacaaagctttttgatcaaatggcggactccgtaaccgaacgaaagggagattccgctatgctttctttagctcatgcatatgttgattttgcaattgaaaatcccggatattatgaagcggctctgcttaaggttcaggacaaacggacggaaatcgtctctgaccaaattgtctgtcttgtgacgaagctgctcattgaaaacggctatgcaagtgaaaagactgccattcatgcgacaagggggctcagaagcctgctgcatggctttactgctttaatcgcaaaagaagcatttgaacgtgaggaggacattttagaaagcctgtcattttcaattaggacatttttgtcaggattattaataaacaataaaaatattatgtaaacaaataaatggatgtcttatatttctgaatattgtataatatcaagggagtatacataggggagaggcattatgcaatggatgacattcacaagattgaacgattagcggcagcttcatggccggcttattttcaaaaaagcatagggcaatggcttctcagagcgaattttggcgtaaccaaaagggcaaatagcgtatggacttctgcggatatgcctgaagggaattttcagctagaggccgaacttttttatcaaagtttaggcttacctgtttgttttcatattagcaacgcatcaccgaaagggcttgatgacgctttggcagacagccgttatgaaaaggtagacgagtgcttccagatgacagcattgtgccggtcaattatgagccgaacaaatgacaacagccgatttacatacaagtgggaacaagagccatcatctgtttggatagatgaatttattcaattagaagggttttcacccgagcgtcacaaaggttacaaacacattttcgaacgcatgccgccgtgtaaaacttttttcaagatgtatgacaaagaaagcctgacagcgcttggcacggtttctgtcattgatggttatggcggacttagtaatatcgttgtagctgaggagcacagaggaaaaggggcaggaacccaagtgatcagggtgttgactgaatgggcaaaaaacaacggagcggaacgcatgtttttacaagtgatgaaagaaaatctggcggcagtttctttatatgaaaaaatcggattttcgcctatatcggaacaccattaccggattaaaagatgaccaaaggaaggggtttgctgatggactcgcttcaagagatgatttgcgaaaaacggacatacacacacctttatcattcacataagcacgcatacagccaatttctttttccgcttgaagggagtattgatcttgagactgaagagcgccaggtgaaattaaagccagatcattttttatatattccgccggagtgtgagcatcgtttccgttctatcggaagaaatgaatgtcttgtactggatgttccgcttcatgcaatgaaaattgatgagtatcgtgcaggatcaggatttgaagctgccctcgatcctttctggtcttcgatcaggtatttgctgacagaggaagcaaaggccggaacagccaactcgcttcatatgctagtacaatacataaaagaaaagcttcaatcccatagctatgcctcaattgcatacattcacagccatttatttgagcggctgacgattaagaagctggcagaaatcgagcattatcacccagcttactattcaagctggttcaaaaaacagacagggaagtccccgcagaactatattgccgaccttcgccttgaggaagcaaaacgaatgctgatggagagaaatgaaacccttaccgtcgtgagcgaggcgctgggctttcaaaacctttcttcttttacaagatggttcacgaaaagcacaggaatgccgccccgcctgtatcgaaacaccttatattcggataaaaaatgatggctctttcgttaaaagaatattgtatatctcctttacaataggagaaaaaggagttattgatatggcagttattgaagactttgagaaattggatatcagaacgggaacaattgtaaaagcggaagaatttcctgaagcaagagtaccggcaatcaagcttgtgatagattttgggactgaaatcggcttaaaacaatcgagcgcgcagatcacgaagcgttataagccggaaaatctcatcaacaagcaagtcatagcagtcgtgaactttccgccccgccggatcgccggatttaaatcggaagtcttggtcctcggcggcatacccggccagggcgacgtcgtccttttgcagccggatcagcctgttccaaacggcacaaaaatcggataacgcaaaaaaagacgtttgcctagggcaaacgtcttttgcgtattgaggcgatgcaccacacgccacattcgtgtgtgccgtaaggcatgtacatcggcttacacaattcagctcatcgctatatgaatatagcatggagggcgaaggaatgcaaggattactttgttattgtgattgaatttgtccgtctaatcaagatcttattatatgaaatgtaataatcttttagtacagaaggtgagcatgaactaaggtaagcgattgacctcataagcaacacgtattccagattcaatcgcgccttgcatccacgcatgagtgagtgaggcgtgttctccggcgaaatgaattctgccctcagggacaggaatatagggatacagctctaattcttgtcctggttcgaaagctgtaaaacctcccgcagaatacgggtactggctccagctaaaagaagtgccagacacaaattcagaccacacaatatcaccatagatttcagataaatccagtaaagtatactggatacgctctccttctgaaagactgtcccatattagtgcctcatcagcccaagtataactcgccagaatgacggcatgtccatttgctccaatatttctgcttggataatatgaaaaacgaatcggaagatcagtaatagatttgccgccgcgctgaccggctttttcccaaaatcggcttttaaactctatgccgatttttgttgcactgatatagtttagctcacggatggccctccgtttatagtaagagaatgaatggtatggttcgacttttacaaatcgcaatgttgaaaaaggaatggttacaatagcgagatctgctgtgaacgatgcaaattctgccgtttgttgatgctgacaatggatcgtaacactattttcaccctgagacattttcatcattttttgatggtatagaatgtttgtttttaattgaggaagaaacgcgtgaggcagcagatccataccgccagttatctcatagaagtgagcgggcgatgaaaaaaagatagattcccgcaatacttcaacaagggacatccccatatacgcttccatatccaaaagtacaccgatcatatcgatcgcgccatatgaaaaatacgtgtttaaaaaagagcttaacgaatgatttttgtattgttcttcgacaatccgccaatttctcgctggattttgattgataaaatttagaataggctgcagtaaagaaagcaacagctcttcagacgttttcccttgttcatttggtgcaactggatatctcaatattccaggagctcgttcaaaaacttggagacgtgttttgattccatttgcataaatgatgtccatcggggttctgttgataaatacatttgttggcaatttgaattttttgatatattctaaggttaacgaatggttattcggtatgcgcatcgggccagcgttgaaatacaaatcatcactaaagggagatctcaaagtgcagacacggccgcccgctctgccgctcgcttcgagaatcgttactctgtgaccggcatttttcaacaaagatgctgatacaagcccggacaatccagctcctataacaagaatgtgctttggatgctgtgacgcgctaaggccatttctaatgatctttaccatgtcatcattcattagagaattcaatttttggaggcacctctttttagaatttattgcattatattcactgaaaagagcacctatcacgatctgttcacatcttttggaatttgaaaggttattgttaaaaggaaataaaggggtgatgtatgtgactaactttgttcataagacggtaaatggcttgaaaagtcttttagatgaaaaaggagccattcaattgttttgttctgaaggggatatcatggagttccttgttacattttcacaggacaaagcaacccttaacgacattaaaagctttgaagctaaacatcagattacccttccagaggattatcagaagttcatgacactgcataacggtgcgaaaatttttgagattctttctgatggggagaatataggtggaggacttcagctatttagccttgaagagattgaagaggagttaaaatatgaggatttgtttgaagatatcaatggtattccaattggctacttattggaagaatgccatttaatgatcgataaagataaagtgaacgaaggtgatcccaactatctctatatatttgaaagtggtttagaatataatccattaaatgtaaactttgaaatatttttagaccggtatatattggccaatggggaacctttttgggattggcgctactataccgcagaaaattattatagaacaagatagtgtgtgatgtataagacagtcattttggctgtctttttctgttattcaaatagattactgtggtaaaatttacatagagtagtctaggaaggagaatgatatgaaggtatttgaggctgattcattactctttgaggccgataaaagaaccaaagagtataaggaactaaggtcgcaaatggtgaagctaagaaaagcttttcaaaacgtagctaacctagatgacagtgaattttcaggcaagggtgctgacaacattaaagcattttatcatgatcatgtcggtgttactgatcaatggattgatttaattgacatgaagattgctttcttaagcagcatgtctgcaacacttgaagatgcgaagatgtctgatgcttacatagaagaatcctttctagaacacgagttggctaacgcttatgcaaaatcaaaatccattatgtctgaacagaaaaaagcaatgaaagacatattaaacaacatcaatgatatccttccccttgaaatattctcaacagaagacttcaaagacaaactttcttttgcagatgacaaacgtgcaaaaacaatcgataagctaaacaagcttgatgaggatttaaaaacagaatacgctgaaacagaaccaaacgaacaatttattcagcaagactttaaaaagctgcaggaatcaacaggcaaaggaaaaaacgctacaccaattcactataacgctaaagcgtacagagaaagtgacatacataagaaaaaaggcgatattgaaaagcattctgaagcttacttaagtgtgaagaaagaagaagcaaaggaacgtgaaatcaaggaattaaagaaaaaacttaatgacggtgtatctgaccctgatgaatatttagagattgctaagaaagtagggtacgagaatctggagccaactcaagtgcagcttgcagtgcaaattgaacaagcgaagcagctagaaggagcaggagaaatcacctgggatatcgtaaaaggtgtcggagtaggcttatataatgttggcaaagacactgtaactggcatgtgggatttcatcaccgatccgggagaaacactctcagcactggggaatgcagttattcatccggtgaaaacttacgatgccatttcagcagcaatagaagagtcatatcaaaaggatatggtgaatggagatgcctattctagatcaagatgggttacctatgctattggttcagtggctgtagctgttgttggtacaaaaggtgcaggagccattaacaaagcagatgcagcggggaaggtcataaacaaagcaagtcaggcagggaagaaaattaaggacgtcaagattccagatttgctgccttataatcctaagtacgactttgctctagccgataacgtgccatacaatgtggttgatagccaaagccttaagaatgaacttttgactaatgcgaagaaaataccggatggaacaagaaaaccgtttactggccaaaagataagccccccttggctaaataaagaaaagtatgatgcatatgaaatagaggggaaggtaaaggcgaaggggaaagttaaagatgtaagccgtagagtgtatactatgaaagatattgatattaatcaaaaaacagaattcggtgttacaaatcttcagctaatgaaaaacgggaatgccccttatgcaaaagacggtacacagattaatttacatcacttgattcaagaagaacctggcccaatgcttgaaatcccgaacagcttacatacaaaatatagtgatgtcattcatcagcttaagtctgatggtgaaagttttagaaatgataaggttttaaaagcacaatacgagagctttagaaagagatattggaaatggagagcgaaacaatttgaaaatgagaattgaggtgtttatatgatttattcgaaggttgagaactttattaatgaaaataaacaaaatgctatatttacagaaggtgcaagtcatgaaaacattggtcgcattgaagaaaacctccaatgcgatctccccaacagttataaatggtttttagaaaaatacggtgctggtggtttattcggcgttttggttttaggctacaactttgatcatgcatcagttataaatagaactaatgaatataaagaacactatggccttactgatggacttgtggttattgaagatgttgattactttgcttactgtctagatacaaataaaatgaaagacggagaatgccctgtagttgaatgggatagggtagttggttatcaagatactgttgcagaaagctttattgaatttttttataataagattcaggaagcgaaagatgattgggaagaggatgaagactgggacgattaagtaaaaatattgcaattgctcaatagatacacttgagttgcacatcctcaatctaaataaaataatggttttatccataaagcaattgtattcaaataacatttctatatggttataattaggataaggattatgctttttaaggtataaaaaatgcataaaataaaaagactagggtgctatcaacaccccgtctctgtactaaagctacccactaaagggcttgctcgatgtgatttcttggtagacctatcccttcaggttcttaggctcaagggaggtctattttttatttatatatgtcaacagagcaattacaaatgacccgaatgcaagcattagcattaatgcctggatgttgacatagcctcaccctctttcataggggatgagcaagactcccttgagtgagaaaattaatgtacaggagaaaatatactttacataaatgttcttgtcgttataattccataataaattaccaatgtgaaatggacgtgctttaatgcaagttcttctttatttcaaatcctaaaaaactcatccaacagtataaaaataagccaaaaaatcagcttttaataaaatcagagattttggccattaaaattggacaaggaatcttttttataaatccttaatattaattatattttaataaataatctggtccttgagttgctaaaaatattcatctgctgcttcttttgattcaagaagttccatacttaataacacattcacctcgttctacaccttcaaaatatgacgtctcgtgacctgattcttgagcaaatttttctgactgggtaatattagggatgatttgtaaggaatataaagatttaaaagaatagtttttatcccaattgtcttggggacagccattggcttgtaactaatttcgtaaaagaagctctgcatttatgcaggacttctgtcgtaagtttcatggtcagtatcaggcattgttcttttccagtctatatctcgacactgaaagtaatggaataaagcaccgagaagattagcatcatttccaaatttgcatgcttctattattggacgtacttttgcaccctgcaatgaattcattatgatatcaatttttttatttatttgtttgataagattttcattgctgctgactgcgccgccaataataattttctccggatcataaacatactggaggttgaaaatacccttagctaaagataaatgaaaatcatcgatggctttcatgcactcccgatcacctgcttcagctgctgcaaatacttgttttccatctaaactcgatacatcgattcctttaatttctgcaacccgacgaacgagagcacctattgcagctaattcactccatgtccggaaagaaatattgtttatatcatcaacagtatccatgatcatattgccgaattctccgctgtgcaagttagctcctttatgaacttttcggtctattacaactgcaccgccgattccagaaccgattactacaaataaaacatcattgttacctacagctgtacctttccaaacctcacataaagccgcacagtttgcatcattttcgatttcaactggcaaaccgcttttgttttgaattatttcttttatattagggccgtgtatacaagggagggcactggttccccctataatgccggtgtcgctattaactcccccaggactgctgagagcaatcccggaaatctggtacttatcttgattttttctcgttacttgtaacaattcagagatgaacttttcaaaatcaaggggtgaagaaggaaatgaacccctggtaagaaaatcaccattttcattaataacagcatatttaatcgcactgccgcctatatcaaaaaccatgtaattattcataggtatccccctttttacaacgcagtttctacttccttcagtacaaatatctcggaagagaagtcacctggcaactccctttgccaatattcataagcgcggtctgtgtagtcctcagctaaaataattcctatattcattaattcatcaccgtaatgattgctgccccgctctttaatatgataaagtttctcagggtttaggccttttaatttaatacggtagtatttatcgtttggttttgcgaggatcttataatatcccacgattgcttctctttgatcttctgatacaatcatccaagacacttcgttggattcaaaagggttttgcagccggtaaaactgtccgttacgaattagattgcgtttttctttaaagaaggaaacctgttctttcacttttcttttttcttcatcatttagttttgttacatcaagttcgtagccaaatgtgccgaaataggcaacatttgcccgagattcaatcggtgtggtcctgccgacctgatggttcggaacagccgaaacgtggcttcctatagaatttagtggataaaccatagaagtcccatattgaatttttaatcgttcaactgcatctgtgtcatcactggcccaagcttggggagcataatatagcatccccggatcaaaacgagctcctcctcctgcacaagattcaaacaaaatttgtggatgtttttggattaaacgctcgtaaagactatagactcctagaatataccgatgataaacctccccttgttgatctgcagccaagctcattgaataagcttctgtaatataccggttcatatcccatttgatgtagcttatttttgtacccgtgataatctcatccatgagcgagaagatatgatcgaccacttcttctcttgtaaaatccaaaataaactggttgcggccatgtgaaggcgagcggccaggagtggcgataatccaattcggatgttcatttaatagctttgtacctttgcataccatctctggctcaaaccacaagccgaattttaaccctaatacatctattttttcagataagcctttaatgccagttggcaatttttctttgtttgtgaaccagtccccaagtgaacttgtatcatcatgtctttctccaaaccagccatcatccaaaacgaatagctcaattcctaagtccttggccgccttggcaattgttaagattttttcttcattgaaattaaaatacgtggcttcccagttgttaattaagatagggcggtctttatcacgccaatttcccctaaccaaccttgtacggtaaagctcatgaaatgtttgactcattccgtttaatccttggtcagaaaacaccataacacattcaggggtttggaaggattcttttgaatttaatttccacttaaaacagaaagggttaattcccatcattacccgggttacactatatgcgtctacttcaacctgggctaaaaagttaccgctgtataccaggctgaatccatatacatcaccggtgtgttcagtggtatccggccgcttcaaagcaagaaaaggattgtggacatggctgctggcacctctcgtgctatagacagattggattccttttgatattttttgcacttccatgtgagcttcacgggcccaagctcctgctagatgaaccatttcatagttgtcgtctgggaaatcaacattcatgctcatagcattattaagataaaatgcttcctcaccggtattgataaatctagaatttcggcaaataacacttctatccgcataaatagaataacttaaaattaatttgctctttaaagtatgatccactaatgtgatttcgatggtctccgcttcactctcattttctacataagtcgcaggcaattgattgagtaggggctttccttgaataatttcatagctttcaaactgaaaatttgtaacatggctgcctgcatcatttgttatcatatgggcgggatatcgatagtctgtagttccaaaacttgggtattcttgttttatgtgttctaatgatgaagtgtgatcgccttcaaacatattgcaagaaggtcttatttcgcgctcaataagatgcttaaatgactcccggtgttttattttttttccataatacaggtgctctagttgcttgcttttttctaacaccctaaaaatataactaatatttcggttgaaaagatgaaattctttcgtttcctcattgaccttaatcggcattactattcaccactccttactaataataaacccttattttagaaagcacttacaaaataatagagaaaataaaaagaaagttgcaagcgacttaaattataacaaaaattatcaaaataaactatttattttttgacaatataaacttaaattaaaactaaaccgttacttaataaacgaactcatcacaaatcatgtgtctaatcttagttatttcttgatagttaggaacaaattagaattaaatcaatatttgtaagcgttttctgttttatttttgaaaatttcaaaaaagtatagacatttaattctggtgaatatataattattttattaagttagcgattaacgattgtttaagttaagttaataattaagttaactgattagtgatttaatttttttaaaagggagtgaaaaacaaagaattttttgaaaactgatctaaagggtttgaaggttttcgagaattcccaggatatttgataaagtcatgtggagttccttattaaaaattagataaggcggggtggaaaatgcataaatcgaaaacatttttgttctacatgttcatcttaccttggttgattgggttctttgtttttacagcggggcccatggtgtattcgttatatatgtcctttactgactattcgggtcttggatcagcaaattgggtaggatttgaaaattatcaaaagatatttacagaagatcctttgttttggcaatcattatggaatacacttttttataccgtttttgcagtaccgcttggattgatagttggttatctgttagcggtccttttaaacgcaaaagtaaagtttatggggttttttagaactgtattctatttaccgtctcttgttcccactgttgccagctctttattatggatcttgatttttcagccggattttggcattgcgaatgcgatcctttcattttttcatctgccaacctcgaattggttgctgagtgaggcaatggttaaaccttctttaataattatgagtctatggggagcaggtggaggaatggttatctacctggccggccttcaaaatgtgcctgcctctctctatgaagctgctgagcttgatggagcagggaagttatcgaagttttggaatataacaatacctatgacatcaaacgttattttttttaatttaatcatgggactcatcggcgcttttcaaatttttacacaagcgtatgttgtaagcagtggaaacggtggaccaaattataaatctctattttatgttttctacttgtatcaagatgcattcaagttttttaagatggggtatgcatccgctcttgcttggattctatttctcatcattttagttttcacactgattcaatttaaggtatttggaaaaaaagtctactatgaatatgacgaataagtgagggagggaaagtggagtggaaatcgcaaaagtaaaaaccaaagcagtgaggataaaaaaagagagcagcataaaaaaaggtaaactttttgaaagaattctgacatacggacttcttgtcagtttatctatcgttttcatctttccatttttatggttggttgggacatcactaaagcctgaaaatgaagccatttcttttccacctagtttgctgccgaaggtatgggattttgcgaattatatagacgtattcactatcgtggactttggtcaatattatttaaactccatcattgttactgtagcaacggtaattgggacggttttatcctcgacattggtagcttacggttttgcacgaattaagggaaaaggacgggatgtttggtttatcttgttgttggcaactatgatgctccctccgcaagtcaccatgattcctgtatacatgatttttgcgaaacttggttggacaaatacttttttgccgctaattgttcctgctttttttggtaacgcttactttattttcttgcttcgacagttttttaaaaccatcccaaaagagcttgaagaatcagcttatttggatgggtgcagcactctgggaatcttctggcggattgtccttccgttatccactccggcagtcattactgttgccttgctgagcttcatgtggacttggaacgatttcttgggaccgttaatttatctcaatgacgattctaaattcacgctagctttagggattctccaattcaagggtgcattattgatagaatggggaccaatgatggcagcaagtgtgcttattattctgcctttgataatcatgttttttgttgggcagaagtatttcatagaaggtatcgctactactggtggaaagtaatagctaggtttgattagtaagggtcacgctagataatgaccttttctggaatcttatctatattttactaaataaatagggggagtaattcgatgtttaagaagaaaggattaggtgttttccttttaacccttgtgctggctttatcagcctttttgtcgggatgttctggatctgatacgtcaagtggggactcaaagaatggtgtgacgctccgtatattagtttggaataacaatccagaaggtacaaaactggaaaatgaaatctttaaagcatttgagaaagaaaatcctggtgtcaatgttgaaatggtttatgctccatacgataagtttaacgacaagttcctaacaatgtctgccggcggtgaccagccagacttagtttggatccaaccatctgcctttggacagttagtatctaaaaatgtattgatggatctatctgataaagagatcaataaagatgaatacttgcctaacattcttgaaatgggtaaggttgatggcaagcaatacgcgctgattcgtgatgcagcgacattccagatgggctataacaaagatatgtttgatgaagcaggagtgccatatccttcagatgattggacttgggatgacttccttaatgcagcgaagaaattaacaaaagttgaaggtggaaaaacagtacagtttggaattgaaaactactatactggggaaattttggttcaaaacgggggatcatacataagtcaagatggcaagacagtgacagtggactcgccggaaacaattgaagcaatccagtttggatccgatcttatcaacaaatataaagttcaaccaacttcagctcaagcacagggcatgtctaatttgttcctaactggaaaagcgggcatgaaattaatgggcccatgggactgggcagatacagagaaaaacgtttcctttgagtgggatgtggcaccaatgccagcaggaaaagccggcaatgtatctgcagcttcttatctgccaatcggtattggaaaagggacaaaacatcctgaagaagcatttgagttgctgaagttcctatcaaccggtaaagggcaggatatccagattgatacaattaacgcaattccagtggtaaagcgtcatgcagataaaataactactatgaaaaacgcgccggagaatgcagcttcattaggaacgcttcttcaagaaggcaaaactgttatgaatgcaccgtatacacctgattatgccgagattgcaaataaaatccagccggtcattgacaatattaatttgaaggatctcgatgcggaaaaagaattgaaaaaaattgcggatcagattcgcaaagaatataacctgaaataataacgaaaaggtacttgttaaatcaagtaccttatttcaagaaggtgaaacggatgaataaaagtacgtatttagacagcaaggttttctggataatggatttggtctttagcctggctaaaacgagtgtattcttttgggtagcgttgataaaagagttctttatatttggtcttgttgcttctttctgtacattggttgaaatgatggatgaagttcttttggggaacggggtttctattagggaaggacttcgagagagaagccaaaaatacaaaggttataaaaaaatttcattgtttactttttgtttttttatttatacagggctgtttatcatatttccattacctgaatccgtaccggcagatataggagtttttacaaagtttgcgtttgtttatttgtatttattgggagtggtgctattcacatatgtatcgtggaacttggttaagttgaatttaagtgtaaagaaagctttattttatggtttttatttaatgtttaaaaggtttgtacgatctattttattatttgctgtatttttagtcatagttttattaagtcagatgaatttaatttttcttatattcattgctccttctctctatgttatgtgtgggactatgatattgagaaaaatctacaaaagtgaagttttgaactaagaatactagatctgacttagaccgttatttgtttgcaggatgcacctaaggtttatcaaatgtagcctgcttccgctttttatgttcctgctctatagtggtgcgtaatagatgtgtttgtgcggaagactcagcaaaagcagtaaaactattctggagagaactctaccagaatggcggagagcgataattataaggtaatacaacataagatttcttttttcgcttaaacatacgccttgaaagaatgttcttgaggtaagcctgcaatgttatttcacaattaaggagtgcaaagaaatgaataataagaatattatccccgagggttttttctggggaggagcggtaacatcttttcaaactgaaggtgcttggaatgaggggggaaagggcccgtctatagtagatgcaaggccggtaaagaataatcattcaaattggaaggtagcagtggatttttatcatcgctataaagaggatattgcgctttttaaagaaatgggatttaatgcctaccgcacaagcatttcatggtcaagggtttttccagatggagaaggagaacctaatgaagaaggtttaaagttttatgatgaattatttgatgagatgctgacaaacggaatccagcctgttatcactctttatcattttgatttacctttggcgttggcagaaaaatataacggttttgcttccagaaaagtcgtagagttatttgataaatatgcaaggacagtatttaaacgatttggaggaaaagttaaatattggcttacttttaatgagcaaaatcttgttttaacaaacccgcaatattggggagttacattggctgataatgaatcagttgaggctttaagatatcaggtgtgccacaatgcttttattgcacatgctaaggcggtaaaagctctgcatgagttagtgccaaatggacaaatggcaggaatggtaacctacctaacaacgtatccagcgacctgtgatccaaaagatgctatagcaaatatgaaagcaaaagagttattgacagacttttattttgatgtatttgtgcacggcgagtatccatcttatgttaccagtcatcttgagcagaacaacataatgccggtgtttgaagagggagatgctgaattacttaaggataacacagttgattacttaagcctcagctattatcagagtcaaacggttaagcacctgccggaaacggatggacacattatttcaggtgtatgtccgaatccaaaactagataccaatgagtgggaatgggcaattgatccaattggcttaagagtggctttaaaagatatgtatgcccgttatcggctgcctattttcataacagagaatgggattggtgtaagagaagagctggacgaaaaccaaacagtggaagatcagtatcgtattgattatctaagggaacatattgaacaaatgaaactggccatgaaagaaggtgtagatgttatcggatacctttcgtggggatcaacggatattttaagctctcaaggtgagatgaagaagcgttatggctttgttttcgtaaacagagatgaaacaaatttaagagatttgaatagatataagaagaaaagcttcgattggtttaagggagtaatttcttcaaacggggttaagttataaacaaataatagttttgtgctagatttaaaacgttgataattaatgatttgccatactccgcctatatccattgtttatattaaaaacagtgaatataggctttaattgttccgctcatactattcgctgctgttgtattaaaatttacgtaccaatctgtgcacgctctcggggtggatttcagtaagcctcattgacaaaagattttattagccataaaattaagttatcgattaacaataattcagagaggagcgaggatttgaaaactaatattaccatgcgagatattgcagaaaagcttggtgtaagcagcgtaacagtatcgaaagctttaaatgataaagaaggagtcagtgctgatctcaaattaaaaatcaaacaagtagctgatgaaatgggttatcgctacaacacatcagcccgtgccatgaaagacgggcgttcttataatattggtgttactattccagaacgatttacgggcatgacgcagtcattttatttaaacatctatcagtctctgtctaaatcgctggagcaaaaaggttattacggcatccttcacattttaagttcaaatgatgaaaaaactttagtgccgccacgtatttactcggaacaaaaagtagatggtctgattatattggggcaggtcagtaaagaatacattgagatgatgcagtccgtaaatattccagtagtatttatggatttttatgatgagaaaacagatatggatgcggttattacggataacttttatggcgcctacgatttaacaaactacttgatcagcaaaggacacaaggaaatcggatacgtcggtaatttatacgcgacaagcagtattcaagaccgctttttgggttattataaatcgctccttgaacacaggttagaaagaaacgacaattatattttaaatgaccggaatgaagaggggaaatttgtagatattcaattgccagaccaaatgccaactgcctttgtttgtaactgtgaccaggtagcacgcctcttgattaataagctcgtcttacacggatatcaggtaccggaagatgtatcagtagttggtttcgacaatgatgcttatgcaacaatcgggtttcctgaattaacaactgtagctgtcgatgtggaagaaatggcacgtaccgctgttcaatttatgtatgaaaaagtaaacgatccttctaaaaaatttggtcgggtccaagtaaagggtcgtatcatttaccgcgattctgtcagttctccaactgcctctccccaatgagtatagacctcttgtctatgcttttttatattcaaattattacaatcatagttttaataaaattagtaagttaataagctttgcacaaagtaattttaatgttttctaatcaaagagaagctatacgaagtcgttgtagcggagagcatttgacacctattaagtgaatctgttgggcttttccaacagattcactatatattctgaattataaaggaaagatgttaattgaaacagatccgtttttccattcataggcccgaatcagaatagtagccattatatatatgtgctcagtggctggccggtatatcggtaaagtctgtttttccagaagatgatacacgaatattatcaaggtaaatcgtgccgttaacaggttctgatcccgtagcatttacataaatagaaaacgcccttacacttttcaagtgttcagctgttaatgtttctttttgccgttcggcagattcccatggggccggtttaaattcggaaaatgggattgatacctcgctggcttttttagaagcaagtgacggatacgcctcgaaggcgattcctccggcattgagttgaacaaccattttttgatttccaccgtctgctttcagccagaaatcaattgaatctgcttcagcccagtcaacactatctagagatttggtcatgccagtataacctgctccagctagtgaatagtcatattttaatgcataggaaccttccgtttttacgctactggttaacgatagctttaagggatcaccttgagtagcaaaggcagcctgcagctgttcatcatcgccataatatgtctcaaatgtatcaacaactgttggtggctgtttttctggctcttttaaatacaccttaatcgtttgtttttgagaggttccatcagcaaattcggctgttacatgaatagttgctttgtcaccttttaaagcagcagacccttcataataataaccatcacctttgacaagagggtacttcttcgctttgtcattcacggtataataaatatctttgggtttaccctgaatcacactaacgctgattggtgtaactttttggagcgaaagactacggtcaattggcgaaacaatatgcataaacggcttttctgcaactgtttccggtactgctcctctgtatatattcccaacatctttcgagaaagcagaataggggtctttataaaaattgataaagtcaggaagtaactcgtgatctccgagcccatttggtgcatttttgtatggaacaaacaagttgccattaagcccgaagttagcccaggtctgcatataagaaatttttcttgcatagggatctgctttgatggcatcaagcactctcgtgaaccattgtgtgtcaaggtttccgtttgtttttaatccaagtccatattcagttaaagcagctattttccctttcgagtctgctaattttgagagcatgccaagatctactacgagagtatttaaaaacccttcagaccccggattgtttggattatcatactgatcaaatcctaaaacatcaacataatcatctccaggataggtttttaggtatttctcttcatctccgttaaaagatgcacctggtgaaaaagcgtataaaaagttatcgacgccttttacatcacgcaagtattctacagtatatcggtaaagttctttgtattctgcagccgaagtggtttgagctccccaccagaaccagccgccggtttgctcgtggaacgggcggaaaatcacaggaatatctttgccttcgttgtctttcaaatcatttgcaaaagcagcaatgttgtcaagccattcattgaatctagcattatagcttccgcccggcaggatatttttgactacacggccgcttgtgtcataaaagtcgccgccggttacaaagttatgcggatgagtactaagcgttaagatgccaccaagttcatgtgcggttttcatcgatttgatcagattggctcgattttcggcggcagattgttcacgtgatcccggcttttcatagccatcaagactgagcgtatcccagccaaagagggcgggatagtcaccgaccgagtttttcacttcagattcggtagaacctgtccgcagaccgggtccggtaacggtaattccctcatccgttgcgtgctgctggccgaacaaaactttttcgccgctaatactttgcaagtaagaaaacagctgttttgtcgacgttgatgcttcagcatctacaagattaataatctgctcctgggcttgtgcggaaggcataagaagagaagaagataaaacgaaagcacccgtaaaagaaatccatccttttttcagcaaaccagttcctccttttaatcatttaatgttgaaagcgcttcaattttatattatatatttagttgcttaataaataaagtaaaaaaattaatttttaaggttttcgataaattaaaaagatgtgttttctgtaaataaactaaatttcttgtttgaacagaaggccggttgtaaaaattctacacacagaatgtcgcgagggaagagtgtccttggctgtttaatgagataaagcacgtttatgaaaatatgatcagtgtagcaaagataagcatttctttcccgagcttttagataggccttttttaaaaaaagacaaattgacgaaaaggccattcactgcatctaacagctttcagcatatggagagaatttggtttgatgtgcacagtaggcattggaaataatatgttgctgagtaagcttgcgcttgacctggaaagtaagaaaacaaagagtggcattgcacgttggagataagaggatgtgccaaataaactctggaagtttcacccgttgtctaaaatgtgggggataggagggaggatggaaagaaacctaaatcggatggcaatatcgactgtagatcagttagccaaatttcctttagagctgcttgaaaagaagttcggaataatgggaaaccagttgtattatcatgctcatggaatcgatttatcagaaataggagctcctttgatgcaagggcagattagttgtctctgaggtacttgaatttaataaagagttgaaattcaaactctttaacaatggattcgttgaaaatgtcaccggcagagtccattacattaattttgaacaacacaggcttcatgtaaaagaccagaatgacaatacaatgtctttggatcaaggcgtttccattcgtttacttacgagcggctttcgaaagctgggtttctcggacaatgtttcagcgcgggtattaatcattttatagccgatcttttcatctttagcccatggagggataataccggttattggatccatcgttgataattgtcaggatgttttgtgaaggagcgacattatagctagggtgatattcaccttcaggtaaggattgatctatgttgaattgctcaatgatgtcatcaaactcagaaaataaagtgaacttgccacacatgttcatcatcctttagggtttttgaatattgtacaggcttgatacacaaaaatcaaaaaggaggaatgtgatgcagcagcaaacagttgagggttaaggaagttgaatggagaaagaaaaggtcagtgatatttatacaatacattaaatagtttttctataaatagttctgatagactgtacaataataagaacgcccccatatgggggcttggatctgcttaataaccattaaatcccttgatttcaaagttttctgtatcgagatttaggctattcaattgctttaacaacacctcaaattttaagcagttaccgtttcttaattcatctggaatatatttaggatttgcaattttcatgccattctcaatccattgttttcggtataactgaattgcagcttcaattaagtaatctggcgttacaataaaacctaagcttacttcatgatcttcactgtagccgtattcaaaatcacaacaagggcagatttcaaatgttttttgatactcaccatcattgtttaatgggttttgaattaatcctttatatccgcaaattaaacatgtatataattttggcatagcaatccctctttatatatttatagttcctattgatttttataataattataaccagcctttttatttggatgttttggcttaaagtaagttattatagtgtccttattacctgagcgttctacagataaaaattcatttgtctttttattatacttatacaaagggattgagacagttgcaaggaatggtgaaccgtacacagttttgaacgatttgctgtttgcaacaggcaatttacatattggtctggggtacgattatttaaagtgcattgccttactaatcaatgtcaaaagattttttagtgtaacagagtcatatggaaatatttctgataaattagctgttgctgctatgaagggtgtgcaatttgatcagttcgaggaagcttacaaagcttataaagaaacagttacaataaatcaaaatagcttaatggactatttaagtgctttaattactctgataaaagcaggtgagaagccacaaaaagctggtgaaagtttagctatcatcatgaataaacttattgaaatgagttggaaaattcaatgatataattgttttatgcaaaagcccttatgcgggctctttttaattgttgtttgcagtaaccaattttaaaattttccgtataggatctaacatctcaggtgtaagtttatatccatcccagtggatataaggtttttctatttaggttttttctttccactttaggatcaagatcatccgttaacccaagtatgtaatcaactgtaacatcatatagcctagctaaaataatcaacttgtccaatggtggtttttttctttcagttttataccgcgccgtaacttgattttgcaattccaattttctcacctaactgttccattgttaatttgtgtgcctttcgtaattgacgtaatctttggccatacattttgaataaacgcctcccaaaaccatctagttcaattatatgagctttcatttctccataaaataaaaaatctcaaaaaaatttcaaaactttcacgatttctggtggaaaatgcattataatgtgaaagcattactttaaaaatggtagcaatgaactaggaggaagtcatggtaagcaagaagaacaaaattgtagcggcattattagcatttttcttcgggggtctgggaatacataagttttatttgggaagagtaggacaaggtattctatatattttgttttgctggactggtattccgtctattatcgcatttattgaattcattatttttctttgtggaagcgaagaagcgtttgatcaaaagtacaatttttattacttccagcagcaatctaaagcttaattttaaagagggatatacagtccctctttaaataaaataagaattttaaagatatttattttgaattggaggctcggttacatcccacagttaccctgattgtcaattcttttttttctttttcagagccctttcaaataaaaatcttgcaacttctttgtaaaactgatctaagctaccatcctcaaatttttggtcaataattctaattgagcagttctttcttagtataaccttaattgttttcttcttcagttcttcatattcttcataaatttgcttcccttcattagacaagcggcagctacaataatttcacaatctctaatgtatatctcctttatttgaaatggttcaatgggaattcattgcagatattactccatctgaattagaaacaagaattgtgatcctgcgaaaaaaggatcaggatatggtggaagaagaccacttataatgtgtttctaggtatttgtaattaaattacaaatacttttaatatttgctcatgaattcgtggtattatactgaaggggacgatcaaaagctttggcgttagtaattaagaatgttttaaatgtatacgagtgctacctcaaagtcggaaaaaatattataggaggtaacatatgtttaagtttaaaaagaatttcttagttggattatcggcagctttaatgagtattagcttgttttcggcaaccgcctctgcagctagcacagactactggcaaaattggactgatgggggcggtatagtaaacgctgtcaatgggtctggcgggaattacagtgttaattggtctaataccggaaattttgttgttggtaaaggttggactacaggttcgccatttaggacgataaactataatgccggagtttgggcgccgaatggcaatggatatttaactttatatggttggacgagatcacctctcatagaatattatgtagtggattcatggggtacttatagacctactggaacgtataaaggtactgtaaaaagtgatgggggtacatatgacatatatacaactacacgttataacgcaccttccattgatggcgatcgcactacttttacgcagtactggagtgttcgccagacgaagagaccaactggaagcaacgctacaatcactttcagcaatcatgtgaacgcatggaagagccatggaatgaatctgggcagtaattgggcttaccaagtcatggcgacagaaggatatcaaagtagtggaagttctaacgtaacagtgtggtagcagatcatctttaattaggggtagctaacgggctgctgatcgttccttgagaagttttataatcaatgattattaaaatcgttagtaatgcttaaaggttgttttctactaggtgaacggccttggaattgctggaggtagggtattctccatctggttttataacttttcctataggttaatagaatggtatttaaatgagaatgctatcaattttttgtagtcagcgcttgctcacaacagacacctttacataacccttctttataaaacataagccttactcaaaataaaaatatctcagtagttaaccagaatcctcataactttatactagttaaaggtgggactgttaagaacaaaaagtctaatttataaatggggactctacgaacaaagcaagtaaattcaaaaagaacccaactttaggatttccttagaggattgaatcagctcgaaccaagttttttaatgcgactagttacggaaattaagaaaagaacctggtgtaattgcccaggttctttttatattgcacaaaaacagacacggtgatataatcacactacgtgcgctttctggttaaaaagttatagatacccatcctataattttattatatcctgctgggaagctcttgtcaatatttattttttgaaggggagatgtagaatgagttctttggttctcggtttacatgaaattgaaaaaacacagctttcgctcgttggaggaaaagggttacatttaggggaattatcaaaaattcaaggtatacaagtaccagaaggattttgtgtcacaacagtaggatatcaaaaagcgatcgaacaaaacgaaacgttacaagtgttgttggatcagttggcgatgctaaaagttgaggaccgagatcagattggtaacatcagccggaagattcggcaaatcattatggaagtagacattccttccgatgttgtgaaagcagtggctcactatctctcccagttcggcgaggaacatgcctatgccgtgcgttctagtgcaactgctgaagatttaccacatgcttcttttgccggtcaacaagacacctatttaaatataatcggcgtcgatgcaatcttgcagcatatcagtaaatgctgggcgtccctatttacggatcgcgcggttatttaccgtatgcaaaatggatttgaccacagccaagtctatttatccgttatcgttcaaaggatggttttccctcaggcttcggggattttatttaccgctgatccgattacctccaaccgaaaggtgttatccatcgatgccggttttggacttggtgaagcactggtttctggcttggtatctgccgattgttataaagtacaggatgggcaaatcatcgataagagaatagcaactaaaaaaatggctatctacggacgaaaagaaggcggaacagaaacacagcagatcgattctgatcagcaaaaggctcaaacactgactgatgaacaaattttacagctggcacgcattggaagacagatcgaagctcatttcggccagccgcaagatatcgaatggtgtttggtccgcgatactttttatattgtacagagtcgtccaatcactactttattccccatccctgaagcgagtgaccaagaaaatcacgtctatatttctgttggtcatcaacaaatgatgacggatcccataaaaccactaggattgtctttttttctgttgacgactgctgcacccatgcgtaaagccggtggaaggctatttgttgatgtcacacatcatctggcatcccctgacagcagagaagttttcttaaaaggcatggggcagcacgatcagctcttaaaagacgcacttatgaccataataaagcgacgagatttcataaagtcgataccaaatgataaaacagcaccaaatcccagcagaggcaatgcagatatgccggctcaagttgaaaacgatccgacaatcgtgtctgatttgattgagagcagtcaaacatcgatagaagagttaaaacaaaacatccaaacgaaatcaggatcagatttatttcgttttattctggaagatatccaggaattaaagaagattttatttaacccagaaagttctgttgtgattcgaactgctatgaatgcttcattatggattaacgaaaaaatgaacgagtggttaggtgaaaaaaacgcagcagatacgctttctcaatctgtaccccataatattacttcagaaatgggtcttgcgctattagacgtcgcagatgtgattcgtccttatccagaggtaattgattacttacaacatgtaaaagatgataattttttggatgaactggctaagtttgatggcggaagcaaaacccgagacgcgatctatgattatctcagcaaatacggaatgcgatgtaccggagaaattgatatcacaagaactcgatggagcgaaaaaccaactacacttatcccaatgattcttaataatatcaataacagtgagcctaatgccagccatcggaaatttgagcaagggcgacaggaagctttgaagaaagaacaagagttattagatcgattgaagcaattaccggatggtgaacaaaaagccaaagaaactaaacgaatgatagatatcatccggaatttcagcgggtttagggaatatccaaaatacggcatggttaatcgatacttcgtttataagcaggctttactggaagaagccgaacgactcgtagaagcgggcgttattcaagaaaaagaagatatatactatctcacttttgaagaacttcacgaagtcgtacgcacacataaactggattataaaatcatcagtacacgaaaagacgagtacaaattatatgaaaaactatctccaccacgtgttatcacgtctgatggtgaaatcgttacaggtgagtataaacgagaaaatctcccagccggagcgattgtaggtctacctgtttcctccggagtgatagaggggcgagcgcgtgtcattttaaacatggaagatgctgatttagaagatggagatatattagttacctcctttaccgatccaagctggacaccattgtttgtatccataaaaggcctagtcaccgaagttggtggactgatgacccatggagctgttatagcccgtgaatatggcttacctgcagttgttggcgttgaaaatgctgccaagctgataaaagatgggcaacgaattcgcgttcatggtacagaaggctacattgaaatcttataatgtctgatgtgtgtagagagccatcagatattccgccatcagccctaactagaagttgggaggctgcatttgtaccgaatgattaagttcccgttaaactaacgaagatcgatagcacattaagaaaagctggaacctcttggaggaggtctggcttttctatataaaattggcgtagtgtgcaaaagccgcattttgcgggcggcgcttctttaaagtgaattttttattaccagcatttaaacttgtatttgtgcttaaaacaagagaaaaaggagctaaaaagctcctttataaatttaaacaacttttgtataaatagccgtgtaaaacccgattgagtaatcaaaataatgacgtgtaagcgtataagtataaccgttgtattctattgttggctggaagtccattggcagaggactaatgcggtatatagtatcataatcatattcatcactttttactgcaacctcagacgaagtgccagcagccaatgcgggaaccgcggatatgagcatgccaaaggataaagcagaactcaataagattttcctaatcttcaattacatcaactccatttacaatttatacatatattatgttataattggaagttattttgaaagtgaataatggatcataaaaagtaaaaatctcgattttaaagggagcaaatatatgtatagtagacgacagtaatgataagtatatttatgctggaacccaaaaagaagcagcatgcaataatgagtttgatagcggaataagagtaagggtatggttcgaaggcaaccacatacaaacatttgagaaagaacaaaaagaagtagatccgtttggtgaatgtcccttacatattaactaaagtgtaagtcaatgaaacaatgaataaaaaatacgaaatataagatattgcttttgaagaacttgttttatgtttttggaatgtatagataagtgcaaaaccaaagaagaaaactgttacaaaccaagaagtgtattgtggaaagatggcgaccgccaataccatgattgttgaaaaaataaatgaagagtaatgagttacttaatgatcatcattcaaagaaatcacctctacgaatttttacccgatttagtctgtgtattaccagcttgtaaaagattcaatatgagaaaatgaagaagtttctggatagatttacactacagtttattgatatgtagttatggagtgagattgtttaacattacgggagggagaaagttgcctaaaatcggagtaagcttgatagtgctcattatgctcattattttccttgcaggctgcaataaaaatgaacaaaacggagacgaaacaaagatgcagagcctagtaggctatgtcgtgcttaaagacaatgaaagggcaattctcattaccgatacaaaagctccaggaaaagaagattacaatctttctgaaggacaacttatgaacaagtttaaaaataacatagtaattgtaggattaagtgagattgataacacagatgatctcaaaagaggtgaaaaaataaaagtgtggttccatacacgaaaagagtcaaatccaccaagtgcaacgatacaaaaatatgaattattataaaaaaattgttgaattctcatatagataacctctgagacaacaaatgttgttctattgcattgaaactgccagtgaccaatatcaagttcagttatgttaattcaagtggtttgatatgttagtgtcttcgaacgagacgaaatattggaagtgagtccggatattcatgagtattacaaattggtcacagaataagagacttaagagagttgtctgcattgtatgttcacttgtatctttataatggcttgcactaaggagtatattcttggaagaaaagaaaacggattttagggtgcttagtcttaattcttgtcagattcaaactttacttgttccataaaatgaaaacttgccgttaattataataatgtttaattttgtggtgtttaaatatatgattctagaggtcttatgaaagaaccgttcatcaaaaaatgaacggtagaagttaaaaaagtaatgtcttttcctttgtggcaaaaggctaaacatattatttgagatcgttaaggacgacttttgcagcctcagcgataagagcattatcataattagcatctttcgtaaagcggtttgacagaattgccacaacaataggagctctgtttggcggccaaacgatagcaatgtcgtttcgtgtcccgtaacttccggctccggatttatcgccgacttcccatcctattggagcgcctgcccgaatcagttcgtcaccagtagcattgcctcgcatccaatcggttaagatcgtgcgtttgtcagtcgtgagagtgttatctaaagtgaaggctttaagatcggttgccagtgcttttgcggtgctggtgtcacgaatatcaccaggaatcgcagagtttagatccgtctcgaatcgtttagctttcgttacatgatccccaatctgtttcagtgacttttcaaaacttttagggccgccaagctgttgcaacaagatgttcccagcggtattatcgctgtaacggatagccgcttccgagatttcttttaggctcatgcctgtatctaggtgtttctctgtgattggagaatatgtaacaagatcgttcttgctgtagtggatgacttcattaagtttttcaattgagtttttcttcaggacagcagctgcggctagaactttataggttgatgcgtaagcaaatcgttcattcggccgataggcgattgtcttgtttgaacctgtatcaattgcataaacaccaagcctggcatcaaattttttctcaagttgaactaattttttattcgttatacagcttgccatgtttgtgtcttctatggattttgcttcggcatgcgttgagctgtaaaaaggtgtgaaaccagtaatgcttaaacataaaagcccaacacatattccgaattttattgacgctttatttttcaacttcatcaagcctcctcattcaaatgattttgtattacctttgaaatgtttcccatgacagttagtgtaacaaacccctttgcgctagtaaacatagaatcaattgatcttatatttttaataagttgggagaacaagggcaattgcccacctacatggtattatataagaataggcaaatcagaatacatatgctgacaatggctgtcagcaaagtcatctattagaaagctttatcaattgtgattggagtgttattggatgcaaacgagaaaagtttatctctacgtatttcacacaatgtcagactgggaatatggatatttaattgcggaactaaactcagggagatactttaaacaagatgcagcatctttaaaagtagttacagtaggggttaataaagaaatgataactacgttgggaggattaagcataaaaccagatatttctcttgacgaatgtactcttgggagtcaagatcttatcattttacccggaggaaacacttggggagaagatattcatcagccgatcttgaaaaaagttggcgacgctttaaagctcggcacgactattgctgcaatttgtggggcaaccttgggcctcgcgaatgaaggatacttaaattcgagaaagcacacaagcaatgacctagactatatgaaaatggtctgccctaattacaaaggagaaacactatatgaaaaggaacctgcagtatctgataaaaatttggttactgcatcaggaattgctcctctggaatttgcagtagaagtattgaaaaaattagatgtatttgcaccagatacattgcgttcatggtataagctgaataagacttataagcctgagtacttctttgagctaatgaatacaataaatcgatagaaaacactttagcagttttttgtagtgctcctgaacttatgggagcattttttatatgtgtctaggagctatataaagaaatgcagaaacttttaaaaagaatatagattggtaagccttaaaactgttcttattaaggctcatttcatgatgctaaagattcatttggagaagactgtcttgatcagaaaagacccttccaatatattgaagtaaaaagatattgggaggaactcttttgaaaaagatgttgatgttagcttttacatttcttttggctttgactatccatgtaggggaagcttcggccgttatcgtgaaagatgaggagaaagtgagttttacaatgacagagaatgaaaaatggtttatgaagtctgatgacctaaattcaaaccattggatatctcactttgggtacagattcaccattttcgatactgaaggatgtacaattaacgcaagaatcatgcgaatgactttgtcaggatatgaaataaccgttagtgaaaaaaacttctcaggggatcattttgatttgagtgcaactgatcgagttgagacgatgccttataagactcattatttgattttgacaaaagatccagattgcggagatgttaaagtaaaaggtctatacggttttcagtttgatcagccagaatggtaataaaaaagaatctagattctcaccggcctgaacgccagccaagctaatgtctcacatgcagacactagcttttttcattgtttaataggctgtcgtcaggattctagaagactttctcataatagtcgtctcctgtcacatgaagcccaaatgacaggggaaatgtatatcattcacactttccgtcgtgaaaatgtaaatgtattcataaaaatcccgcagcatatcagcagtgcgccgaggataatgttgatggtgatctgttcgtgcaattgcagccatccaaagaatagggctaatacgggaacaaacattaatgccatggatgcttttgacgcttcgatttgattgagcacccaaaaccatacgacaaaggtaaagccggtggaaagcaagccattaaacagcaatgaccacaccgcctgatatgtccactcggctgaagggaccggctcaaatataaaggaaaacaccaataacatgacggctcccatcataaggtgccaggcattcatgtgaataatattgatatgcttgaattgtagcttgctgaacacattcgcgattccccagctaagcgctgccgcaaggatgcacagctccccaaataaagcgctttgatcgatattgagcatttcctttccaaatataaataacagtccgaagaggccgcagaccagtcccatcgttttatacacattcattttctcgtttaatgtaaaatggctgatcaccgtaacaaatataggcattgtatataccaaaacagaggttttccctgaatcgacaaactgcattccatacgtcaaaatccccatatagcccagccccatcaacaggctcatgatgatatagcttttgagatgttctttttttattgaaagcttttttctttggatgaagagaatgagaaataaaggaactgctccgatgaacaggcgcaaacccgaaaataaaagcggggggatgtcatgaattcctactttcatcgcaacccaagtataaccccaaataagtgtgacagatatgattcccagcataacttttaccataatgaagccgcctttcttgttaaaatatcgtgctggtttctatcatatgttacatttatgtataactgaaatacatttttattattgggggtataaccaaatggttatgaacatgaaccatcttcacatatttgtaaaagtcggggagaaattgaatattacagaagcggcaaaagaattgttcatctctcagccggcggtaagtaaagcgataaaaaacctggagagctcactgcagctcaaattattgatcagggataaacatcatggtttaatgctgactgacatcggaaaagaaatattgttgctggcgaggcaaatgaagggaattgaaagcaaaatatatcaagtagccaaccgggaaaacaagctgttaaacgggaaggtgaaaattggttcatttcctgcagtttcaacaaatatcatgccacaggcgattgcggcattcagatcaaactacccgctaatccgcatagaattgatcgaaggaacctctgaccaaataaaaggatgggttgaagatcgtacggttgatatcgggatcgcagcatctccatttgaaccgtttgaaaatcagctattgtgtaacgactatatggtggccgtcatcccgccgcagcgtgacgaattaaaacttgaaaagcatgtcgaccttgaaacatatcaagatgacctcattttttgtaaaggcggtcatgaaatcgcgatgtcaaacgcattttcgcaatacaacatcgaattaaaggaaaacttaactgtgcaaaatgccgaaaccttgattaatatggtcaaaaataacttgggtatcggcatcatttcaaactttacactttcatccgtcccgcatcagttgattaaaaaggacatctttcctagggtcacacgcgatattggcgtcatcgcacattcatttgaagagataacgccggcggcgcatgagtttgtcaaagtgttgaaagcagttgtaatctgaatcagttatcgtgttgcgatgaaattgaagaagatgaatactcaccggcagagttacataaaagaaaaaagcaaccatttgaacgttgcttttcactctatttgggaccttgtatgctaagaaaaagattcatccatctctgcctttgtgggactctgctccttaacttgttttaatgatgctactataagaaagctaacaatcactagcaagagccatgaacttacctttccaaggtgtacaagactccatgtatcgatttggtttggatatttccaagctccaaaaaacgtagcgatattttccgctatccatataaaaaatccgatgagtacaaaagaaagtgcgagcggcatacggtaacgagctccattcacctcgtatgtaacccatgtttgccaaaagacaatgatgacaagcccagataaccaccatcgaaagtctatagaaaaatggtgggtgaaaaaattcaaataaatcgctgcggcaagcggaacaactgcaaaaaaaggcggccacttaaccagttcaaccttaagccttctccatgcctggcacaaataactggccacacttgcgtacataaaaccgctatacaaaggtactccaaatattttggagtatccttcttctggataagaccaggagcccatatggactttaaaaagttccagagcaagcccaatgaggtggaataatgtgatcacttttaattcatcccgtgtttcaagaccggaacgcaccatccacaattgcatgagaacgcagataatgagcagccagtcatatcgcggcaagaagggcagtgggatgatttgcgtaatagccaaagaggcaaaaataacggcaggaaacaaacatgaaagggcttgttcccagccaaaatggacgatttgttttatggctctcatgatgtatgcctcctccatagttgtgttcttcgtgtatgaaagggacgcttagtatagcagctagatggatataagtttatgtccataagctcaccgccaatcactttatttttctgttgatcttacctatttttttacgaatcctgtgtgtcttcatcacttcggtattccaatatatccccgggctgacattctaaagccttgcaaatcgcttctaaagttgataatcgaatagcctttgcttttccgtttttcaatatcgaaagattagccatggtgatgccaactctctctgaaagctctgttacgctcattttcctcttagcaagcatcacatcaatgttgataataatcgccatgtcatcacctcagaccgttaagtcattttctgattttatatctatcgcttcttttaacagtttttgaagaacagcagcaaagaccgcaatcaccattgaagcaaaaataataaccaatccgatcacaatgatagccggggcgtcgtctatctcggccatcagataaaagacaggcatgcctgctgcgtaaaagatactgatagtgactgcgcaatattttatattcttcaaagctcttacagacaaacccgagaaagctttgtttttgtcaatatagcttaaaagtttgaacgcttgataaagagcaaagtaaaaaggtatcgccgttacatacaaatagatgaaaacgagatattttatataagcgatatttggaaataattctgctgaatagttggaaatcttaggcactaaaaaaatgcataaagcaagaattggaattccaataagaaccaaagctatctttaaaaaaattgtcgacattcgattcataacaagcacctcatttatttgttgtctaattgaatgtaacaaaaaatttatcgtttctcaataaaaaaatattgaaatatattgatttgttattgttataggagacccttttcatttttgacaagacaaaaaagcatccctcatcattgggagatgctgaactacttcaaacttgccgactgaatgaaccgtgtccctcagtgagctcagggatcggtgtgaacataaagctaagctcttttatgaaggtttttatcaacgtcaaagattcaaacaaacgatgggaagaaatacatcaaaggataagcggctgttcatactaatgatcgggaggtaaaccgacttatgatacaaattttgatcactggtctttttttattggctcagccgagtgagccgcaggacagtttaacggtcacacagcaaggacggacgattgccactgttaaccgtgaagactttacaatgcctcttcccggcactccaatggttgactatgaaaaatacagtaaattcatcaaacagcttgatcagaaagtgtaccgtgagccgataaatgctgtccttaacgatcatggaagcatcgtcccgggcagggttggctacaaactgtatcaacaggcgtttatggaaaagttttatgcgtatttttatgggcaaggtccctccaagatagaagtgccggaaatgaacatttatccgaaagttgacagcgagctgttagctcacatcagtacgcagcagcttggtcagtacgtgacgtattttaactcaagcaataaaagccgttcacacaatatttctctttctgcaaaagcaatcgacaatcacgttgttttccctaatgagacgttttcgtttaaccaagttgtgggaatgagaactcggaacaaaggatataaaagtgcacccattattgtaaaaggggagctgtctgaaggtgtaggaggaggaatttgtcaggtgtcctcaactctatttaatgcagtcgatcgtgcaggactgcagatcgttcagcgctattctcatactagaagtgtaccatatgtaccgcccggacgggatgcgacggtaagctggggaggtcctgactttcgctttcaaaaccaatataaccaaccaatcttaattcgggcaaaaaggtatgggggaagtatgattattacgctatactcttctgatgtgattaacagcaaattgagaaaaatccccaaagctccatctcggataccgaaagaaataaatgcagagcagtaaagacaaaacctcaggtaaggttttggttaagagagcttgtagattgatcaaaatcaattctttaaggagcggccagtgaaaggaaggagggataaatgaagtgaaaagggtattattttctgtaattgtttttacagcagttggatttacgtttggccaatcaaaagcgcatgccctgacttttacggtgttgcctattacacaaaaaacagaccagtggtcagtaaaagtaagtgaagcaaaaaatgcaaaggaatttgcgagacctcaaaaaggagaatatcaagtatattccttggaagtcaaaaatataggggaaaaagcagctacagtggatgtgcaattgtatagaaatgaccctaattcaatcacaaggttttcgctttttggatgtcccgatgaaaattgcgtcaaaccaaaagaagattctaaaatgttagctgaaagtttaaatgatggctcactgctgaagttcaatcattttatgctggcagataaggcctctgaattagaggttgttataatttggacacagaaggggcaagaaggacgcaatttaaaacagacctttaaattcactgaagatggcgttaattagacagtaaagatggaatggctttggtgattcgatctcttactttgcctgaggaaaaaatgaaaataattgttggaaaaccaatcatagctgagtcaaatgttaaagtgactgtgatttatgactatagagaagaaccagaggccttttggatacattatccgatgggagtgaaatgtttgttgatgatcacaaagtctttattgaatacgaatagagactttgtgactgactgcgcatttcaacttaacattttactgataatgacagtgaaacctaaacaagtgcaacctgtttcatcattaaaaaccgctaatttcaaaattttctatgtcaagatttagttttttcaattgtttcaacaaaacttcaaattttaagcaattgccatttttcaattcttctggaatatcttccggatgagcaattaccatcccgctctcaatccattgtttacgatacaattgaaatgcagcctcaattaaatgatcaggagttacaataaaacctaacctcacatcatgatcctcactgtagccaaattcaaaaccgcaacatggacaaatgtcaaacgttttttgatactcgcctttatacaaaggattttgaattaatcctttgtatccgcaaattaaacaagaataacatttttccaccaagtttaattccccttttatcacttatttactattgctgtcccgtaacaaatattacttcaaatataaacttcgtgtactgtatttatagcataagcagtgcatctaatcctcaaagatgaacacactttggatttgaaatgggtgatataggaatcaagataatatctgaataaaagaagggttttacagttaattggcaaaatggaaaagaaaaagtatttaagttggaacgggtatttattctattaggcatgtaaagtgtgccagcgaaagttgaattccatgaaattatgttaaagggggaaaagaggagatgtgctacattgaaatcacaaaggacaatattgaagacaatcatatttgctgtgcattaggcgcgaaacaatatgagcatgcagttaatgaaaagaagaggtggctcaaagctcgaatggatgaaggattggtgttctatcgcttacatgaacgggcaaaagtctttattgaatatctacctgcgaatgaggcatgggtgcctgtcaatgcgcctaattttatgtacattaattgtctgtgggtgtctggcagatataaaaataacggtcatgcgaaacgattgttggacaaatgtatagcagatgcgaaagcgtgcggcatggatggcattatccatatcgcaggcaagaaaaaactgccctatttaagtgataagcatttctttgagcatatggggtttactctacaagatgaagctgccccttattttcaattaatggctttgacttggaatggccttgcagcttctcctacatttaagagccaggtgaaaagtgattctatcaatgaaaaggggattacgatatactatacagctcagtgtccgtttgcagtgggcatgataaatgatttgcgggaattgactgaaaagaaaggggttcaatttcagtcaattcagttatcatcgaaagaagaggcacaaaagtcaccagctatttggacaacttttagcgttttttttgatgggagatttgtgactcacgagatcatgagtgtaaataaatttgaaaagttacttaatacactagcttgatttttaataataaaaatccattttaaggttcttgactcaatgaaacaaaaaatgcatttaagagctgttatacgttttaatcttgtctttagagagcactttaatttaagtcaaaagtttagacagtcatctgttagatcattagcccttttttattttcttttcggtaacattttgatcatattttcctactaaaaagttaggaaagtggggaaaaacatgagaaaaaagaacaatattaagaaatggctattgatcattgctggattcttgatcatctgcatcaccacattatttgtaatggtgtcaggaaacgaagtgaaatatgagggcagcgggaaaagcggactgtggatgtctaaccttgaaaaatcaggaaaaacttcaattggacccaattattttctaaatctgtattggcaggggagtaagaaggacgaaaagaggactgtcatagaaaaaatcaccttatacatagatggtaaaatgtatgatgacagggaaaattatgatttgtcagaatacacaggtgaagaaatgccaggtgggggacgtatggaggaccatatcgccacctttgattatatgcctgaagatgaagtgataggacatgatgtattagtgaaagtggagtggaagacaggccagaaaaaacagacagaagaaatcaaattacataagaagccatggtataaaaaatagcttatttgatatgtttgtgatcacattggtggtcacttttttatttggattcctaggcacagcaatctaagactctgcataggctggaataaaatcttgttcatttctaaaacgaggtgcatgctgttggaacaacaaccaatcaatcatgaagacagaaacgtgccgcagcctattcgaagtgatggagctggagctattgatgcaggcccgcgaaatatgatgcgggatattcaaaatccaaatatacttgttccgcctgttacagatgaaggtatgattcctaacttgagattttcattctcagacgctcccatgaaattagatcatggcggctggtcaagagaaatcaccgtcagacagcttccgatttcgactgcgattgcaggtgtaaacatgagcttaactgcgggaggcgtccgtgagcttcattggcataagcaagcggagtgggcttatatgcttttgggacgggcacgtatcactgctgttgaccaagacggacgaaatttcattgctgatgttggtcccggcgacctttggtacttcccggcaggaattccgcattccatacagggattggaacactgcgagtttctgctcgtattcgatgatggaaacttttctgagttttcaacgttaaccatttcagattggcttgcacacacaccaaaagacgttctgtctgcaaatttcggtgtcccagagaatgctttcaactctcttccgtctgagcaagtctatatctaccaagggaatgtgccgggatcagtcgcgagtgaagacattcagtcaccatatggaaaagtccccatgacctttaaacacgagctgttaaatcaacccccaattcaaatgccaggggggagtgtacgaatagtggattcttctaacttcccaatttcaaaaacgatagccgctgcacttgttcagattgagcctggcgcgatgagagagcttcattggcatcccaatagcgatgagtggcaatattatctaacaggacagggacgaatgacggtatttatcggaaatgggactgcccgcacatttgattatagagcaggcgacgttggatacgtgccttctaatgccggacactatatacaaaacactggtacagaaacattatggtttttagaaatgttcaaaagtaaccgctatgcagatgtgtcactcaatcagtggatggcattgacgcctaaagaattagtgcaaagcaacttgaatgctggatcagtcatgcttgattctctgcgtaagaagaaagtgcctgttgtgaaatatcccggtacgtaaagactgaaccgatcacacagtggtcttaaagtaactagagctgggtgttggcctgtgttttatcaaatccctatatatacgttatgtagggtttttctgcttgaatcgtattgtaatgagctttaaaatgttaatgtggaaatgataaccattcgataatgggaattcaatggccgatttctaccagtttgattggctttaaaggaggacaagaaatgaaagcactcatatttttatccagtttgactgccattgggagctctatattggggcgatggttagggatgctggatgattcttatgctgttggcgatgcttggtttataggtgttttagctggattgatttcacttctaatattgattgatagtcaaacgatgacaaagaattacatagtaagtttaagtacgatactaggcattcttggagtgggatttatatatttcccagctgcattcatcaacatattattaagtattacactggataaacaaaagaaagaagacctccatgtaagatgaaagaaatttcatttaattcttaggagggaaagtgtatggatttacctctatgggcttatatcatatttgcaatcacaggtgcggcaggtttcataagtttaatgtggttcagtttttttgctgacaaaatagaaaagtgaagcaattttataaaatttatatgaaagggataacattgcttatttaagtttacataataaaattatttcaaacttacacaaaaaaataactaattgatctatgtactaaatattcataattactagagggattggccctaaggaacaaagctattgacaagtacttgctagagaatttcaatcactacatatgattttctgcatcaagaagctcagctgaattatttttgggtgaatttactaatgatgaaacctggtatgcttccatgtcatcagcatcataaggcagcagcaaactttgcagataatcagggcttgtattttgggggttaagccactccttttcatgatcatgggccaatataaccggcattcggtcgtgtatatctttcatgaactcattaggctcagttgttatgatggtgcaggtataaagaggatctccttgatgtgtgctccacttttcatataagccagcaaacgcaaaaagagcagatgatttcaatttgatccgcattgggattttggttttggaatcaagccgtttccattcataaaaactgtctgctggtatgatgcagcgtttgctgacaagcggtcttcgaaaggccggtttctcggtaatggtttcggctcgagcattgatcattttataaccgatcttttcattttttgcccaaggtggaataagtccccatctaagcttgcctaagcgattatttgatccatcattgatgattgcaaggatgttttgtgatggtgcgacattatagcttggctggtattcacctttaggaaaaaattgatcgatgtcaaactggtcaataatatcatcaaatgcagagtacaaagtaaacctgccgcacatatccatcatcctttttaggggtttttgaatagtttgtgggacgaacgttcatttaatacaggtccagaacaatgatttcttttcacttgcgataaactggtataataagaaagccagttaagaagttattgtggaaaagaacatatgctttttggttggaccgacgctggatcttgatggagttacaaggatcgcttaaaaatagcctataagtataaaaagaggcacagcgtttttaacgcagggcctcttttatatcagtagccaaataccagagttgtactttgtgatccggcatatttcgtgacaaattcttttgcatattccggcgtttggacacgatagctatagtttgacccgggattccaagaagtcagcggagaggtttgcttgttgagtgatggatagctgcctatgtctttgaaataaccagtgcccttgtcgtcaaggatgccgcctttttcactgcctttcccaaagtaattatattcggaatatatttttgcttttgtagcaattgtaatcgcctggttaaaattattgctgtaattgtttttaacatgaaagtaaccgtatctcatcagacctgggcctctaacatacaagttctcaaaataattattggcgattgtcatgtgggggtagccgtcatattgatgctgagaatcatccgggtatcctaaaatcaaaccgtatttatgattcgcaaattttgagttgctgatcgtgatataatctgcggattttccgatatacacgagtttgtccaaatcgcttccgcttgcactatagctatgacctgagaatgtgacgtgatcaatccaatagttcataccggaatctaaataaagctggatatcattatttccgttaatctgcggactgtgttcaaacgttaaattttgaaaaatgacatttccagaagctgatgaagttgttaaataaatatttttaagcgtttttttcgcgtaagagcccacgagtgttttatttgagccaatggtaactgttgttttcgcagatgcggaaagatcattttgaagcactaaaattttcggagtggatcctcctagatgggtttttaaatcatttacgctttgaatgtaaacaatctgcccgttttttccacccgttgtgcccgttttagagatgcctttttcatttttggcatttccggcaaaacctaaaaggccatttgttgaggtattcggaaaatcggctgcacctaatgcttttccaggcaagagaaccaaaaacaagctaaagacggtgaaccataaacaaagtcgtttcatcacaatatgcctcctttcaattttaatcatttccttgcggggattattattacagttaatggaaaggaatgatagattctatcttcctaattaatgttgggttacttaaaaaatacagattgcgccaaaagacatactaacaattaaaatagaagaaaggattgatacaccgttgactgcagcagcttatcgaaacaccttgctatcacttttatgtttaacagctggaatcgtggatgtaatcgggtatttaagcctgggacatgtgttcacagctaatatgactggaaacattgtattattggggttagctatcggcaaatccattcaggtcactgtttttaattccttgactgcgctaatcggatttatatgcggcgtgatcattgccacattgatggtcggaaaggcggaaaataccctttggccttctgctgtgacaaaagccctcgcacttgaagcattcattttgtttgtctttgcttgtctttctttttaccgggcttttgttcctgtgcacattctaattatactcatgagcatttctatggggattcaaactacagcagcaaaaaaactggggatcgcaggtatttcttcaactgtgttgaccggcactttggcttctcttttagaggatatatccggccgattgttttttaagatgcagaagaagactttcttaagagatactgtgttaagagcactggctattattttgtattgtgtgggggctattattgttgctctggctgagcctgatttttatcacttcattatttgggttccgattgtgctgatatttggcatcatgatgacagctaagttgaaactgagcggggaaaaatagcttttcctgtatagctgttatcacaacagcctgtctcatttcgttattgttatgcgaattttgagagggcaaaataagacattcggctgaagtgcacattcgttcatttgtattggctttttcataagtacctacatttgatatatgaatgatagtgaatttgccttaaaagcatctatgaatctatttcctctttcaaaccagatggattgagtcttataatgataatgattctcatttgaagtctggtttgaggaggaccaaatatgaaaaagatcatgagtgcatttgttggtatggttttgttgacgatcttctgtttttccccgcaagcttcggcagcatatgacgacctgcatgaaggttatgcaacgtatacagggtcaggttattcaggaggagctttcctgctggatcccattccttccgatatggagattactgcaataaatccggcggatctcaattacggaggagtaaaagcagcacttgccggctcttatttggaagttgaagggccaaaagggaaaacaaccgtatatgttactgatctttatcccgaaggcgctcggggagctcttgatctgtcacctaatgccttccgtaaaatcggcaatatgaaagacggaaaaatcaatattaaatggcgtgttgtcaaagctccaatcaccggcaatttcacgtaccggatcaaagaaggcagcagcaggtggtgggcagcaatccaagtcagaaatcacaagtatcctgttatgaaaatagaatatgaaaaggatggtaaatggatcaacatggagaaaatggactataaccattttgtgagtacgaatttagggacaggctctctcaaagtcagaatgactgacatccgcggaaaagttgtgaaagacaccattccaaagctgcctgaaagcggaacgtccaaagcctatactgtaccgggccatgttcagtttcctgaatgaaaaatacgaaacagcggatcttttcccgctgttttttcattgttctgcatctgcatgtaaaaatgttttaatcatgttcaactgctcctgctttggataactggtatacagcctgcttgaaatccgaataggatctccgaaaaaatatctttcgtagtgagtttgtctagttccgaatgaactcattgttaaatcccatgccaaacggaaaattttcacacgttcttcagcatttgtattggttgcttgaagatattggtcaagatcttcccgtatctctgagtcaaatgcattttcggtaggcagtgtcaccattccgctagctccaattaattgtatgatttcagtaaatcgaggatatagcttaggaatgatcgtactgatgacttgaagaggaattaaacaggggcgcatatagccgaattcatctaactgagcatcattttccgatttgtcaatgagcgctttgattgtttccaatcccacaatgatttctgagagcttttcttggatgtgctgatattcggaaacattaatggtatcgacaagaagctgtgcaacacctaatagaaattcaatttttatcatttgtctaatgacaacctggtgaaaggtaaaggcatgaaaggagctttttgtcataaaatctttagctgcttccacattatcgtaaaaaaacacacgattccacggcactaacacatgatcaaaaaccacaattgaatccatttcttcataccttgagcttaagggatgattaaaggaagagtcgcttaatacaaatgattctcttgtgatgaattttacgccttttgtattagaagggattgaaaaagcataagcttcatctgtttcaaagaaatatttaggcgctgaaaaaaccaagatttcatcggtcaatccgccttgtgttgcaagcagacgtgcgccatgaatcattaaacctttttcggttctatcaatgactttagcagatatcggtttttcacttagcccaaaataagactgtgaccggttcacttgcggagtaatgaatgtatgggtaaaggaaaggtcatgcttagcagcttgttcatacatatctagtatatgttcaggaaagcaattctctttatctttgagaagctccgctgacgaagcaaagctcatcataaccgtattcatgtaatccggacttctccccatcattccgtgagtatgtctagcccaatgttcaatcatgttccttcttttttttaaatcatttttggttttaggctggagataggaaaggccgattcgattatgatctccaggaaggcaataagtcatctcatgtattaactcatcctttgtttgcaattcataaagtaagctttttgttttgattattcctttaaatgcaggatgctcagaaatgttaccctttattttttcgccatcataccatatttcgttttctagtttattcaatcggtcaatgaattctttaccattgatgatccccatttaagtttcgctccttcatattatgctgcgtattgtattatattttcgagaaaacagccggttcagccaatttgaggtgggaaaagccttttttagaaaaacgaataagagtgacttacataccgcaaaagactgcaaattttacttaaggtttttctgtaagttcagagacgtaaagaatttgcttattcatatgaaattagcactataaaacttgataacacgtgtcgatattatggacatgagcgtaagcgaattggattcaaacgcgcttgaacatattttatttcagccattacattgtgcggaaagggaaaacgacacatgaaagtgaaaacaaaattgctggggattatatcaatattagttgtttcaattattggaattggaggctcctcagtatttatgatttcttctactgtgaaaaagaatgaagaacttaaagacaaaatggaattccaaaaagagataaaacacatccaatatgaattgaccgggttatcaaatgatgaaagaggcttcttgattaccggagacaaagaatacgacgagggtatgaaggaaaaagcagacgatgtcttaaagagtcttgaccgggttaatgacttgattgatgaagagagatatcaatcaaatatcgaagacattaagacaagttttactcagtatagagctttgaatcagcaagtagtaacagcctactcttcaaatccgaaaaaagcagaaaccatccattttggagaagaaagaacactaagaaaagaaggcgtagatccggctgtcaataagctgtctgatcgcctggatcaagaggtggaggatctaaaagatgaaatacgaggcaatgggaaaatgagtcaatggctcatcatcattgtcaccgggatatcagttatattaggcgttgttttaagcataatgctgttaaagtctataatggtgcccctaagaagcataaataagcagctggaggaaattgcacacggcgacgctgatttaaccaaaaaagtcattgtgaaaaataaagatgaatttggccagcttgcccaatcgtttaattcttttactcattcattaactcaaattgtgaagcagatcagcagctcatctgaacaagtcgccgcttcctccgaagaattatcggcaagcgcggaagaatcgaaatcaacatctgaacatatttcccgagccatgcagatggctgccgacagcaatgtgaagcaaagctcaatgacagaaaagagcgcagaatccatcactgaattattagacagtatatcatcagttgcttcaaatacagggaacatagcggatctttcttcttcgatgagagacaaggctgaaataggctctaagtccgtcaacaagatgttagatcagatgaaattcatagataaatctgtagattcagccggcaatggattgcagacattggtagcgagcacagcagaaatcagcgatatctcttcgcttatcacgacgatttcagagcagacaaatttgttggcactaaatgcagcgatcgaggcggccagagccggagagcaaggaaaaggatttgctgtggtggcagaagaagttcggaagttggcggatgaaacaaataaatctgcaaaccacatccaatcggtggtagcgaccatccaaaatgaatcgatagaaacggtaaataatattaaggttgttcaagaaaatgtgagctcaggtattgttctttctcaagaggcaacaggaaatttcaatgaaatactgaacctcgtggaacaggtcacttctcaaatacaagaagtcgcagcggcaactcaacagcttacatcaggcgttgaagtgattcagcacacagttcatacattggccgctggaacaaaagaaacgtctgctaatacagaagcggttgcaaattcatcacaggaacagcttcattcaatgggggaaatctcctatgccgcagaatctctatctcagttggcagaagaacttcaaaccgtcattaatcgttttaaatattaaacaggctacttacgtgcaacccccatcctattcggtgggggtttgcgacttttactgtggttgcttctacaaacagagctaactgaccttttaagttagctccgtttgtatggctagtccaaattttgatcgatcgtcccttcaaaatagtcatcgctgacctgttcatgagtttcagctaatcctttttctaattgcgtgcttcctttataatctgagggctcaaagtatttcccggcaacatctgttgtgtcatttttgttttctttgttatgagtttgtgtttcagtgtttacactttctgtctcagtattgctgcttatagattgctgaaaatcatattccttgtctaatgaagaaaatcttttataatcatcaggtctgtctgcaccgtttttttgagtcactttacttcctccagattattgatattttagtgggggtaagaacttatttcgttttatttcgttcttttaggctcagaaccatgttttttagggtcatctgctttaaaagctgtttcagtctcatggtcatttctcatttgttcaatacttgaattttgaattccctttttactcattggtttcactcctttacgaaaagtgttgaatatcaactcttcttattttgtctgttgatcaggtattcattcacttttttcattcgcgctttcgccaatcaggagaggcgttttcatgccagcgtattatctaataaaagaacgtcatttttgaaaccttttattagcgcattgcgtatagcacgttggggaagacatctcgataaaacaaatacaaaggttgtgaatttatactaacagcactgtgaataaatcaaacaagggggggggaaatgaaaaaaatcgcatcatattatttaatgacattagggctatccagccttacatttggtttgtttttagggttttattctttcgttatgtatggcgatatgataattgcattgtttacggcagcaattgctttattatacggttttgtggtgtatggcctttttgctgttccgctccaaatgaagttgcagaaaaaagcgagaacattcaatgtcatgtacctattgatttacagtgtggttgcttttatcgcagctttcctgttttttgttatcaatgaacctgcgtcaatagcatggacattgcaatcgtacttttattatatgttaagtattgcggctgcagtaatttactggttatgggattctctgatcctttataaacgtacagcttccggtgtataggctaatttttaccaatcggagaaatatggaggttcaataaaaattcaggatctaaaagctttaggtttcatatttttttaaaaaaatcctccgcggataaaggcgcagtatgggggcataatgagagcacacattcgaaccgaataggttttctaagtgttttacgatacatacgttcatcaagaacatcacgtcatcaaaggaatataaaaactattgttgtggaacgggcatctcgagccgtttgaggaaagaacatagatggtggtttatcgttttatcagcgcttatagaacaaagttttggtggcaggatccatacagctaaacagaggagagcgtgacaatgaatctcgctctcctcagatttgttttattcaccctgatgtttttcaactaatgtgaatgtccaatcttttaacatatgtttctgtacatatttttttccgtttatttcaatgtaaggcaggtctgccatgtctccagctaactgttttgcttcagtcgttgttattcctaaaaaaagtccgatgtaaaagtaaatatcccgttcttttataagcaagatatcattttgttcactaccttttgtatggttcatctgctttaagccttcaccgataaaatatcctgccaaagcaataccaattcctaaaaaaacgtccatgtgtatgcctccattatgtcaatgttatgttatacgggcttggcatactccgggtttcattatttttcaaaccttttcaatctgtacacggcctgaaaaaaaggtggcgccgccgcccatatcggacaatcggtctggggttagcgcgtttacaagctgtttttttccttgttcatccgcccataatccttggctgacaacgacacctggcagcacttgttctccaactgcagcggtcagttggcattctccccggctgttccaaattcgtacaggtgccccatcaacgattccgtgttcttcagcatcctttgtgttgataaagagctttggcgtcttctcaagcttgatgtgtttttcattattggaaaatgttgagtttaagaaattatggtttggccccggaacatacataaacggatgttcattatcggttacaagaggtgtatatgtcggtaaagcagggaagccgtcttgtttcattttttctgaatataattctatttttccgcttggcgttggaagttcgcccggaaacagcggcttttcacgtttcgctttcataaatgaattcttagtaagtgaatcgtaatcaatctctgccaaatgcggattatctggatggtcaagcgcctggcggattaattcttcatctgaatctttaagctcctgatctgtgaatcccattgcttcagccattaatcggaacacctcagtgttagacttgctttccccatatctctcaatcaccggctgctgaagctgaatgtaatggtgccagtaggaggtgtaaaaatcagtattttcaaaagcggatgttgcaggcagtacaatgtccgcatatgcagccgtttccgttaaaaacaaatcatgaaccacagtaaacaagtcttcccgcagcaagccctgtctgactttgtttgcttccggcgcaacgacggccgggttcgttccgtaaataaaaagcgagcgaataggcggatctgtttccaaaagcaccctgccaagctgattcatattaaacgacctcggggtgcgccctttcaataagtcgggccgctgcaaggcatttgtgttatattctaaaattccgctgttatgcttaattgcgccgccccctgtgtgcatccattggccggtgatcgccggaagacaggcaatcgtccttacaatcatcccgccgttatcgtgatgctggggtccgtttccgattctgataaaagaaggggaggtttccccgtacatttttgccagtcggtaaatatcttcggtactgacaccggtgatcgtcgatacctttttaggatcatattgtttcacgtgttcacggaggtcttcatagccaaccgtgtactcggacagaaatgcttcatcatgcatattttctttaaataaaatgtgcatgatgccaagagcaagtgcactgtcggttcccggttttattgggataaaccaatctgcaagacgtcctgtttgatttttatgcacatcgatcacgacaattttggcaccttgttttcgcgctttttgggcgatcgtaatttggtgcatgtttgtgctgaccgcgttgattccccaaaaaataaatagttttgtatgaacggtttcctcaggatcgattcccgcgcttatgcccattgtatatttatagccttcagatcccgctttgctgcaaatcgtccgttcaagctggcttgaccccatgcggtaaaaaaagcggcggtccattccttcagctgtcaatttccccatatttccgtaaaagctgtaaggaagtatgctttcagctccctctgcatcaatcagctgtttccagcgggaggtgatcgtatcgattgcctctttccaggaaatcggttcaaatatcgcttggccttttgcacctgttcgtttgagcggtgtagtcagccgcttttcatcatatatgcgctccgtcatattccggactttgttgcatatgtttccggctgtgacaggatgatcaggatctccttgcacttttacgatttttccgtcttttttatgtattaacaatccgcattgatccgggcagtcaagcgagcaaacggatttgaaaatgccgttttgttgtgtggcaaaagatttcatggcccagttcctctctctagttagatattttgtaagaattataacatttccgatgataacgtcaattctgaaaaaagagattgacatcaatctgagtcttctttatgataaacgtattcttcattctgaaaattacatactcaatattttctatccagagaggtggagggactggccctatgaaacctcggcaacattattgtgccaattccagcaagcgtcagcttgaaagataggaaagcaaggtttataccggcgtctgcctgtaacagagcgcgcctatatatgaatctctttccatctgcggaaagagatttttttatgaaaaaatacgatgaaaaggatgttttgcaccatgacggttttggttacagcaccatacaacgaagaaggacgaaaagagcttgaaaacttgtttggctcagttgcttatcaatcttggaaggaacaaggccgggcatatcgggaagatgaactcattcagctgctaaaagcaacaaatgcgacaggcttgattactgagcttgatcaggtaacagacagcgtatttgcttctgttcccgaactttcatttatcggtgtttgcaggggaatgccctccaatgtggatgtggcagctgcttcaaaaagaggcatacctgttttttatacaccagggcggaatgcacaagccgttgctgaaatgtttattggaaatgtgattacctttctccgccataccagcgtctcgaatcaatggctgaaggatggaaagtgggacagggattacctacaggcttatgtcaaatttaaaggaaatgaattatcaggaaaaacggttggcatgattgggttcggcgccgttggccaaaggattgcaaaactgctgactgcgtttgactgtaaaataaagtattacgatccatacattcaagacgatcatccgctgtatgaaaaagtatctcttaaaacggtgttttcagacagtgatatcgtttctgtacatctgcctcgtactgaggaaacacttggacttattgatcggaagtattttgatctgatgaaacagagtgcgattttcgtcaatacttcaagagcagttgttgtaaaccgtgaagatcttttatctgtattaaaagaacataaaatcagaggtgcgatattagacgttttttatcatgaacctccagaggaatcagattatgaattgatttcattgcctaatgttctggcaacaccgcatctcgctggagcaacatttgaagtggaggatcatcacgtgacgatactgaataaagccctcaaaaagtggaagggtgaaaaaactcttaatattccgacaatgtataacaaggacgaactgaaaacaggggtataagaaaggaggctaagagaatgaaaaaacaaaaaggctatctcgtttttgatattggcacaggcaatgcgagggtagcggtcgtgagtgtaactggcagtgttctaacagttgaacgggaggacatcgtgtattccacagagacgctttacccggacagccgttttttttctcctcaggtgctgtggaagcaggtgatgaatttggcaaaacgtgcgctatcccgttcgcatgatattgacatcattggtttgacatcgacgagccaaagacaggggattgttttgattgatcaaaacggcgatccttttctcgggctgccgaatatcgataaccgcggccgagagtgggaggcgagcattcccgatcgggaagagatatacagccgcacaggccgcctgccaaccgcacttttttccgcgctcaagctttatggattaaaacagcgccagccctctttatgggaaaagactgcaagctttactagcatcagtgattgggtgacgtaccaactgagcggaatattaacatatgaaccatcacaggcaacagaaaccctgctgtttgatgtgaagcaaaacacttggtcagaagagatgtgcgacatattcggcttttctccatctatccttccgcctcttgtaagagcgggaacagcaattggaacgatagcaaatgaatatgcatccgaattaggcctttcaataaatgctaaggttatagcagggggcggggatacacagctggctgtcaaaagcaccggagctggacttgaggacattgtcattgtatcagggacaacaacgccaataaccaaaattactgcggatcatggcgacacaaaacataaagcctggctgaactgtcatacagatcaagggcattggcttgtggaaacgaatccgggaattaccggattgaattatcaaaaattaaaacagattttttatccgaatgaaacgtacgaagtaatggaggaggagatttctgcacttgcaaaagaagaccatgcatgtgtagcggctctcggctcttatttatcggctgaaaagaatgcattaacgagaggcggttttctttttgatgccccgctgtcagcacatttaaagagggcacattttgtacgtgcagcgctagaagagatcgcattttcaatcaaatggaactttgacattttaacagaggttactccgtttgaacgtgactatgtttgggtgtgcggagggggattccaaagcaaagcgctcactcaatatatcgcggatcttcttcaaaaaaaggtctatgtccaagagggatatcatcaggcatctgtcgtcggtgctgcagtcatttgcaatgaaacctttcaattaacggaggagatgtcagcaaatgtccgggtgatcgaaccaaaggactgtcagatagaattggctttatatgaggaatggaagcaaacacagcgctttttttcaggatcagaaagcaaagtattaatttaaggcggcatttctgctgttttgaggaatcatttaattttcaactttaataaggtaatacggtaatgtatattagcatctaaggaggagacagatatgttggataaaataggaataccgaagcggcttgcctggggatttttaggggttgttttgtttatgatgggagatggccttgaacaaggctggctcagtccttttttgatcgaaaacgggctcaccgttcagcagtccgcttccatttttagtatatacggaattgcgcttgccatagcttcctggttttcgggtgtatgtctcgaagcatttggcgcaaaacggacgatgtttatggggctgttgttttatgtgatcggtacagctgcttttatcgtatttggatttgaacagctgaacctgccagtgatgtatgtgacttacttcgtaaaagggttaggttacccgctttttgcttattctttcttgacatgggtcatttacagaacaccgcaaagcaaactgagcactgctgtcggctggttttggatagcatattgcctcggcatgtttgtgttcggcgcttggtactcaagctacgcgatcaaagcgttcggttatttgaatacgctttggagctctattttctgggtatgtctcggtgcattctttgcattgtttatcaataaagaccgttttgaaaagaagaaaagaaaaagatcagaaacagccgaggagcttttaaaaggggttacgattttatttacaaatccgcgcgtgcttacaggcggaatcatcagaatcatcaacagcattggtacatatggttttccagtctttttgccgatgcacatggcccagcatggaatttcaaccaatgtgtggctgcaaatttggggaacgatttttctggggaacattgtgtttaaccttatctttggtattgtcggcgataaattcggctggaaaaatactgttatttggttcggcggagtcggctgcggcattttcaccgtcttattatactacgcacctgttttctccagcggaaatttagcggttgtcagcgtgatcggctttatttggggcggtttgctggcaggctatgtgccgattggtgcaattgtgccgacggtggcaggaaaagataaaggggcagccatgtctgtattgaatttggctgcaggtttatcagcgtttgtcggccccgcactcgcttggctgttcatcggtctcgtcggcgcgcaaggtgtcgtctggatctttgcggccctttaccttgcaagtgcggtcttgacaaaatgtattcatatacctgaggaaaaagcagttaaggaggaaacatctcctcaatatgcatcttaagtagaaagcgccctgtttgagggcgttttttatcatttgttcagcaatgtaaggatttccgatacggaatgacgcaaaaatgattgatctggacgggatttcaccatcacagtcagccgataagaaacagaatataagtctgagccgtttgttccacgttaaagtcttagctcgcccgaatgttctctcaaaacagattcataacgctttatttttcattgaattctcgatgacgagccatcaacattacctctttctgaatcgatcagtatataactattctataaattatcgagggagtctaaagaaaaatagacaacatattgacaatgtaatgagaaatgttaagatgtatagacaataagttgtccattcaaggagggaacatcgtggattattctaaggaactgaaagatttatttttaatgcaacagtcttacgctacatttttttccactttaaacaaaatccaatcacgcggagacgattattatgaaagcttaacgtcgaggcaatttatgacgatggttgccatactgcatttaccggaagaggaaacgacattcaacaacattgcaaaaaaattaggcacttcaaaacaaaacatcaacagacttgtcagcggtattgaaaaaagaggttatgtcatcactgtaccaagtaaacgcgacaagcgtgcagttaatgtgaagattactgattcaggaaagcgtgtcatggaggaatgcggtgaaaaagcggtgtattttatggccgatctatttaaaggcttttcgacggaagagctggaaacattatgggttttattgaagaaactgtacagttttgacggagaagaacaggatggttttgaagaagacgctgctgattttgacattgaacaaaatcgagacaatttgaaaacaaatttattgcaggaattcgcaaaacggagaaagtaaaaaggagaaccaactatgaacaacgtagcaacagtagaaaacttgaaaatgcagtatgaaaacaaaacggcagtagatgggatttcgttcgaagtgagagagggggaagtgcttggcttactaggtccaaatggtgcagggaaaagcacaaccattcatattttatcaggagtattgtcggccagttccggaaatgtttcgatattgggccatagtgtgaaaaaagggtccaaggaaatgaagaaaggcatcgggattgtgcctcaagatatcgcgatttatgaggagatttccgctgagaaaaatgttcgtttttttgccagtctttattctcttaaaggagaagaactgaaagcccgagtcaaagaggctttggagctcgtacagctatatgaccggaaagatgacaagccaaagacgttttcaggcgggatgaaaagaagattaaacattgcgtgcgccattgcccatcagccgaaactgattatcatggatgagcccacggtaggaatcgatccgcaatcccggcatcacattttggaatcgataaaagagctgaaaacaaaaggcgcaagcatcatttactctacacactatatggaagaagtcgaggcaatttcagatcgtattatgatcatgaatgaaggaagaattattgccaatggaacaaaagaagagctgtacagagaagtcaataaagaaataacatacgcttttcaactggcgcatgttcagcgattaaataaaaactcgattagagaaatcataggagtgacaggagttgatttctctgaccatcaactaaatgttaccgttcaaaagaaccaagatcacctgagtgaaatcatattagaattgagtgcccaaggctgcagcatcctaaacatgaacaaaaaagaggcatcgttagaaacggtatttttagagctgacgggaagaaatttaagagattaggagagcaaaatgagtttgttaaaattaataacatttgattttatgaatattttaaggaatccggttcttgtaatagccaatacggtctttccttttgttctgattctggtcatgggctttgttacgaaaagcagctttggagcaggcggggtcagttcttatgattattacggagtgaatatgatgattttcactgcagctctgattgctatgacgacctctaatacgtttatggaggaaaaggtgaagaaggcgaaccttcgtattgtgtatgcgccggtttcgacaactagtatttatctttctaaattactatcaacctttatattcagtgtcattatgtacagcatgaatgtgttgatagcccaaacgatttttcatttgaactttggaggacaatatcttacgtatttcatgcttttattgtatgtatttttatttttcggttgctgttttggcacaatgttctgcagtttgttcaagaatgaagaacaggcgaatgggattatgcaaattccgatagctttttttgttttctttggtggcgtatttttcggaattcatagatttggagataccgtcaatcagatatcgattctttctccgattaaatgggtaacagaatgttcatttcgtctcatttatgatcatgatttcagtatgctgcagcctgttatgtcaggactaatattggcttcaatcatttgtattgccgtttctcatgttgtatttaagccggagggatatatatgctgagtttattccaaaacaggtgggagcgaatcctgaccaaaaaagccattattatcattgcattaatcattatccctctgatgattggcgttgcgattatgttttccgggaagccggttttcaaagaaacaatcgcttttgttacagaactggacgaagttcatcatttgccgagtgattctgcatttagagtggtaacggtagatcagaagccgaagttttctgatctgatgttagggaaatatgcagccattgtagaaaaaaatcaacttgattacagcgtaaccacgttgaaaagtaaagcggatcaaaaaatgattcagcaattttttgagactggagaaatgccaggcagctaccggggagaggatgaattaaggatggaacggggaacgggaacgaatatattaggctttatcatgatgcttgtattgatgcaaggtgtggcattagctgcgttatatccagaagaccggatgctcaaaaccttcaaaaggattttagtgtctcccgtgcatgtggggaaatatttgttggttcagtttatctttacttttttatgtttatacatacccacttacttggccatcctaattacaaatgtactctttcatgctgaaattggtttccgtttaaacattcttgctgggttactgggtgttcttacagtgcttgcaacagcattcgctatctttatggcttctgtgatggatcgaaacatcagtttgatgacgagtggtatcagtgtgatcacgtgtgtattgtcaggctgttttatttcttttgctccacatcatccaatattaaatgccctttgtgcgatactgccacaaaaagcgtatatgactttcattcacggggtagaaatgggggattcaatgtgggaatacaaaactcaggttatttatattttgatgtggtcggctgcgttttgtttccttggggattttatcacaagaagaagaaccaataaagggatttatgagtaggggaaaaaagttattagcattgttttaagagatgaaaatcttgtagggattgatcaagaatcaaaacgtcatagctgatgcaggtcatgaatcggacattttaaaggaaaagggatgtggcacagaccaagagaataccgtcattctcttggtttcacaatagagtacacatttgtatcatatggagtcccattttgatacatgtactgtcttaaaacaccttctttttgaaaccccatttttagaagcagacgatttgatgcttcattatcggtaaatacaactgcgccaatacgcgacagtccaagggcagaaaatccgtaagatacgacctttgaaatgacttctgatgcaaatccgtttcgccaatactccgggatgatttcataaccgatttccgcacgcctatgcttttgggccagagcgtgaaagcctattgttccgatcagttctttagtgtcccgtctttcaattccccaccgtataccgcgtttttcttgatagagggcagcaaacgtttgactcattgaaatggcctgttctatagattccatgttttcaagcccataatagcgtgtcacctcatcgtttgagaaacaagcaaaaatggcttccgcatcctgatctgtgatttgcctaagtgtaagccgatcggtttctaatataggaaacattcaaccactccccgcgtttgtgtctatgtttatcatatcccttttatttcctcttttctatagtgaaatcaaccaatgcagcaaaggaacgaatttgtctttctagttgctctttgtttttgttgaattgtttcaaacgatggccgttcgcgcctgatgggtggggaaagccgttaaggcaaaccaaattctggaggctgtgctgtctgatcaatgtttcacatactgtttcggccgcttttcctaacggaatgagaagagctggtcccgtcacatggttaagctccgcagggaagtacccaaaagcataagtgcttagaataggagaatgagtgatagccggtttgtatccggtatagtttttttgctggataaagacaggatatttaataacggaagttgtatggagcatatgccgtaattctccaaaaagctttgcggcgctttgaatgccaaaagcttgcggcagcccgcataaatccagcatggtgataaggttatgtctcatcgacccggagaaacccgctgctatttttgtatctaccgccatttgctcaagagtgcggccttgccgcagactttcgactgctgtttcgtacgctgttttcatctgggaaaaacccggcgtgatcccggcaatcacaatcgtagcagtccgattgatatattcattatgaggtgaatagtagatgtcaagttcattttcttgatggagatgaaatggagaaataagtaaatccgactttgtaagtgaagagggaagagaatgtagtttttctgcgaactcctttaagcaactgtggtttacaatcatgcgaaagcctcctcaaaaaatgatatcccattgtccattctgatcgaaacaacgggatatcattcatcatgacctgctatttaaatgaccagcctgccacacctctttaacagctttaggaacttcttttacttcagctgcggtctgctgaaacgcggattttttcatttggacatcctgctgaatcttcttttgtttttgcgtcagcagatctgtttctgtttttaatccttcgatttgtttttgcatagcctgcgtaacagaggaaagctcctttagtgcagggtccatttttttcttgttttgaatcacgttaactcctaagaagataatagaaactgctaatactgcaagactgatataaactataatcatatgttcactccttttcttatgtcattaccctgtatccgtttttttaatcagaagaaatgatatttacacagttcgtttgatttgcgtattggatgtattgtacttataatgtgatatcgtacatatgtaaacaaagaaagggtgcttcaattgcaaaatttacaacataaaactgcactaatcacaggcggaggcagaggaattggccgcgctactgctttggcgcttgccaaagaaggcgtgaatatcgggttaattggccggacttccgctaatgtagaaaaagtggctgaagaagtcaaagcgcttggtgtaaaagctgcatttgctgctgcagatgtaaaagatgccgatcaggttaaccaagctgtagctcaagtgaaggaacagctcggtgatatcgatattctcattaataatgccggcatcagcaaatttggcggtttcttagatctgtcagccgatgagtgggaaaatattattcaagtcaacctaatgggtgtgtaccatgtcacgcgcgcggtgcttccggaaatgatcgaacgcaaagccggagacatcattaatatttcgtctacagcgggtcaaagaggagctgctgtaacaagtgcttacagcgcttctaaatttgccgttctcgggttaacagagtctcttatgcaagaagtgagaaaacataatatcagagtcagcgcgttaacgccgagcactgtcgctagtgatatgtctatcgaattgaacttaacagacggtaatcctgaaaaagtgatgcagcctgaggatcttgctgagtacatggtggcacaattgaaattagatcctcgtattttcatcaaaacagcgggattatggtcaacaaatccttaaaaatgaaaacctgtctttcgacaggtttttttatttgaatgaaattcataccggcatatgcaaatctgacaatcgttttaaattgaagctggcagtgaatgtaggctataatagaactaagaaaactatgtaccaaatgttcagtcagaatttattttttccgctacacctataatcagtaaacatgaaatgactggaggactatcagtctttaatataaaaaaggaaaacaataaaaggaaattgaatatttagtacatagtgttgtcagtgacagaagaaggagtgcatatgatgaaagaagaaaaaaggagttcaacaggctttttagtgaaacagcgcgcatttttgaagctttatatgataacgatgacagagcaagagagactctatgggttaaagctgcttgaagtacttcggtctgaatttaaagagattggttttaaaccaaatcatacagaagtataccggtctttgcatgagcttcttgatgacgggatactaaaacaaattaaagtaaaaaaagaaggggctaagctccaggaagtcgtcctctatcaatttaaagattacgaagctgccaagctatataaaaaacagctgaaggtagagctggatcgctgtaaaaaactgattgaaaaagctctctcagataatttttaatagaaacaaacacccggcgcagcattatgaaccgggtgttttctgcttttcattatacatatttgtcgaaaagaaacaatacaaatcaataatagccttcaaacttgacatcatttcctcacgtggtaacattttaaacgtgtgaaaatgcgaacaaaaaagcgaacaaaggagatgttaccgatctttgatcaaaagaaagtagcctttataggagcaggatctatggcggaaggaatgatatcaggtatcgttcgagccaacaaaatcccgaaacaaaacatctgcgttacaaaccgcagcaatacagagcgattaactgaacttgaacttcaatatggaatcaaaggcgccttgccgaaccaactatgtattgaagacatggatgtactcattttggcaatgaagccaaaagacgccgaaaacgctctgtcatcactaaaatcacgtattcaaccccatcaattaatattgtcggtccttgccggcataactacctcttttattgaacaatcattgcttaatgaacagccggttgtcagagtgatgcccaacacttccagtatgattggcgcttctgcaacagctattgcccttggcaaatatgtgtcggaagacctgaagaagctggccgaagcattgctcggatgcatgggcgaagtctatacaatccaagaaaatcaaatggatatattcaccggaattgcaggcagcggacccgcgtatttttattatttaatggaattcattgaaaagacaggcgaggaagcgggcctcgataaacagttatctcgaagcatcggcgcacagacacttttaggtgccgcaaaaatgctcatggaaacaggagaacatcctgagatcttaagagataatatcacgtcaccgaacggaacgacagcagcggggctgcaagccttgaaaaagagcggcggcggagaagcgatttctcaagcgataaagcatgcggctaagcgttcaaaggaaatcagcgaagatatcgaaaaaactgcagcgccgctatcaggagtgataaagtgacgcctgatacaagcatgaaaagagtcgttgtgaagattggaagcagttcattaacaagccttcatggagaaatcagcattcgtaaattagaagcgctggtcgaccaggtcgtcaaactcaaagacgccggttatgaagtgattttggtttcctcaggcgcagtggcggcgggatatcggaagctcggatttatccaaaggcccgagaagcttccagaaaaacaagcatcagcttcaatcggccagggattgctgatggaggcttattcaaagctgtttttggcacacggctatgtcgcatcccaaattttaattacgagaagcgatttttctgatgaatatcgatacaacaatgtcaggaatacaatgaatgtactgctcgagcgcggcatcatcccgatcataaacgaaaatgacacagttaccgtcaatcggctcaagtttggcgacaatgatacgctcgcagcaaaagtcgcaggattgattgatgcagatatgcttgtgattttatcagatatcaacggattatatgacggcaatccgcgcacaaatccagaagcgaaaaggatacagcgggtgagtgaaataacacctgacatcgaagcatgcgcaggtgacactggaagcatcgttggcaccggcggcatgcgctctaagcttgatgcgtttaaaatcgtaatggcgtctggcattaaaggtttcctaggtcaggcagatgccggcgatattttatatcacgccgttcatgaacaggcggaaggcacctattttgaagcagaaggaacgcttccgttgaatcaaaaggagcaatggatcgcttttaattccggtccggaaggtgaaatgattttatcagatgattgttcacgaaaaataacaaacggccaatcgagtttatacctagacggtgtacagaagattaaagggaaatttaaaagcggttcagttgttcggataatggattcaaaagggacggaaatcggccttggaatcgtcaattactcttctgtacagcttcaagaaccggaaaagaacaaggaactgacaaacagagctctaattgatcaagaagcatttgtttgccatgtggatttttctttacctgtaaattaatttgcagaaaaaaacccgaagcttctatatagaagctcgggttcatttttttattgatactgctccagcttagagaaaaattgaatgacaaactcataaaaatcattcgcggaaggcgcaagctctctatttttcggtttaatgattccgacagtccgttttacttgagggaactcaattggaattttcacagtaaaacgaggtgttgtttcagcaaaagtactttcaggcagaagggtaacgcccattcctgcggacactaaccctttgatcgcatccaaatcctcaccctccgtggaaacgagaggagcaaagcctgcttgtttgcaagtatcgattgccatctctctaagtacaaatccttccgggaacaatacaaattggtcgttgcgcaaatcgattaaatgaaccgttttttgtttagcaagcggatgatttaatggaacaagcgcgtaaattttttcagtaaataatatttttcccgttatgtcagagaaattcgtcggcaccggccctaataaggccagatcaatatcgcggtttctgacagcttcaatcagaaacttataggagccttggcgcagcaaaaattcgacgtgcggatattcttctttaaacgctgaaatgacagtcggcaaaagctggctggcgaggcttgtaggaaagccgatctttaccgttccgcgatgcgggtcaagatactcatcaatttgctctttcgcataatcaatggctttcatcgccgttttcacatgaatcaaaaattcttttccgattggcgtgagtttgatatttctcccttcacgctcaaataaggtcacatttaattcttcttcaagattggcaatttgtctgctgattgctgattgggccacatgcaaatgatcagcggcttctgaaacgtgttctctttcagccacctccataaaataacgcagttggcgcagctccatgtttgtctcacatccatctatctcattttgagattcttttgatctaaattatatattgtttatatcgttttgaaaacctacaatgattatagagttgttagattttatgaccggtattatcggaaattgatcgggggagaggaattatgacgtacaatcaaatgccaaaagctcaaggtctctaccgtcctgaatttgaacatgatgcatgcggaatcggcctatatgcacacttaaagggcaagcagactcacgacattgtcaaacaaggacttaagatgctttgccagctagaccatagaggagggcaaggcagtgatccggatacaggagacggagccggcttactggttcaaatccctgatgctttctttagaaaagagtgcaaagacatcaatctgccagaaaaagaacgttacggggtaggaatggtctttttctcacagaaagaagatgaaagaaaaaaaattgaaaagcaaatcaatgcactgattgaacaagaaggccaagtcgttcttggatggagaactgtacctgtaaatgtcggaaaaatcggaacagtggcgcaaaaaagctgtccgtttgtccgtcaggtatttatcggcgcaagttctgatctaaaggacaatttatcttttgaacgaaaattgtatgtcattcgtaaacaggctgaaaattggggagtaacggaaggtcttgatttttattttgccagtctttcaagccagaccattgtttacaaaggccttttaacacctgaacaggttgatgcattttattctgatctgcaagacgaagcattcgtttctgcttttgcgcttgttcattcacgcttcagtaccaatacattccctacatgggaaagagcgcatcctaaccgctatttggttcacaacggtgaaattaacacccttcgcggaaatatcaactggatgagagcacgtgagcagcaatttgtttctgaaagcttcggtgaggacttaaacaagattttgccgattctcaatgctgatggcagtgactcttccattttggataacgcatttgagttttttgtgatggctggacgcaaaccggcacatacggcaatgatgctcattccagagccttggacggaaaatacgcatatgtccaaggaaaaaagggcgttctacgagtaccatagctccctgatggagccttgggacggaccgacagccatttcatttactgacggtaaacaaatcggggcgatccttgaccggaacggtctccgtccggcccgttattatgtcacaaaagatgattatattattttctcatctgaagtaggcgttattgaagttgaacaggagaacgttttatataaaaaccgccttgagcctgggaaaatgcttttaatcgacctggaagaaggccgtattatctccgatgaggaagtcaaaacacaaattgcaactgagtatccgtaccaaaaatggcttgaagaagggcttgtacaagtaaatcctgatccggagtcaagagaagaagaacaatttagtgatcttcttactcgccagaaggcattcggatacacatatgaggatatccaaaaatatctaattcctgttattaaagaaggcaaagatccccttggttcaatggggaatgacgctccgcttgctgtactttctgaccgagcgcaatcactgtttaactactttaaacagctgtttgcacaagtaacgaacccgccaatcgacgcgattcgtgagcagcttgtcacttcaacgatgacttggctcggtgcggaaggcgatcttcttcatccaagtgaacgaaatgttcgccggattaaactgtatacacctgttttatccaatgaacagttttacgcattgaaaacgattgttcatcctgatttaaaaagccaaaaaattgatgtgctgttttcagaggatcttgaacgcggtttaaaggacatgttcacacaggcagagaaagccatcagccaaggcgtaagtttgttaattttatcagacaaaaagatgaacgaacgactgacaccaattccgccgcttctggcagtaagcgcactgcaccagcacttaatccgcaaagggctgcgtacgaaggtcagcattattgtggaatcaggagaagcgcgtgaagtgcatcactttgcagcgttaatcggttatggcgcagatgcgattaacccttatctcgcttatgcgacctacaagcaggaaattgatgaaggccgtttggatatcagctatgaagaagcggttagcaaatatggaaaaagcattactgagggcgtcgtaaaagtgatgtccaagatgggaatttcaactgtgcaaagctacagaggcgcacaaatctttgaggcggtaggaatcagccgcgatgtgatcgaccgctatttcacaggtactgcatcacagctaggcggcatcgatttacaaacaattgcagaagaggcacagcgccgccaccgggaagcgtatcaggatgattacagcaaaacgcttgaaccgggaagtgacttccaatggagaaatggcggagagcatcatgcgtttaatccgaaaacgattcatactttgcaatgggcgtgccgcagaaatgattacaatctgtttaaacagtatacaaaagcggctgatgaagaacgcatcggatttttgcggaacttgttcgcatttgacggaaaccgcaagcctttgaagttggaggaggttgaatccgctgaatcgattgtcaaacgttttaaaacgggtgcgatgtcattcgggtccttgagtaaggaagcgcacgaagctttagcaatcgcaatgaaccgtcttggaggaaaaagcaacagcggtgaaggcggagaagatcccaaacgctttgttccagatgagaacggcgatgatagaagaagtgcgatcaaacaaattgcatccggacggtttggtgtcaaaagccattacctcgtcaatgctgatgagctgcagattaaaatggctcaaggtgctaagccgggtgaaggcgggcagcttcctggcaacaaggtatatccatgggttgccgatgtccgcgggtcaacgccaggtgtcggattaatctcacctccgccacaccatgacatttattcgattgaggatttagcccagctgatccacgatttgaaaaatgccaaccgtgacgcaagaatcagcgtaaagctggtgtcaaaagcaggtgtaggaacaattgccgcaggtgttgccaaagcgactgcagatgtcattgtgatcagcgggtacgacgggggtacaggcgcttctccgaaaaccagtattaaacatacagggcttccgtgggagcttggccttgcagaagcacatcaaacattaatgctgaacggacttcgtgaccgtgttgtattagaaacagacggaaagctcatgacgggccgcgacgttgtgatggctgccttgctcggcgccgaagaatttggttttgcaacggctccgttagttgtactcggctgtgtcatgatgcgtgcctgccatttggatacatgccctgtcggtgtagcgacacaaaatccagagcttcgcaaaaagttcatgggagatcctgaccatattgtgaactatatgctgttcattgccgaagaagttcgtgagtatatggctgcgttaggcttcaagacatttgatgaaatgatcggccgcactgatgtacttcatgtaagtgaacgggcaaaggagcactggaaagcaagccagcttgatttgtctacccttctttatcagcctgaaggggtgcggacattccaatcgccgcaaaatcataaaattgatcaatcacttgatattacagcgattctcccggccgtacaagaagccatcgaatctggaaaagaagcggaagtttctatcgaaatcaacaatacaaaccgtgtagccggaacgataaccggcagtgaaatctcaaagcgttacggagaagaaggtcttcctgaagatacaatcaagctgcactttaccggatcagccggccaaagctttggagctttcgttcctaaagggatgacgctttatttagacggagactcaaatgattacgtcggaaaagggctttctggcggaaaaatcatcgtcaagtcaccagaaggattcaactctgcttcggatgacaatgtcattatcggcaacgtggctttttacggtgcgacaagcggagaagcatatattaacggacgtgctggtgaacgctttgccgttcgaaacagcggtgtgaacgtagttgtagaaggcatcggcgaccacggctgtgaatacatgactggcggcagcgttgtcgttctcggtgatgtaggcaaaaactttgcggcaggtatgtccggcggaatcgcttatgtactggccgaagatgtcaaagcgtttaaacgcaaatgcaaccttgagatgattttatttgaatcattagaggatgagaaagaaatacagcacatcaaagcaatgcttgaaagacatactgcgtatacaaacagccaaaaagcagaagatctgcttgatcaatggaaagacagtgtgaaaaaattcgtcaaagtcattccgaaaaactataaacaaatgctcgcaagcatccaagagcaaaaagctgcaggtttatcagatgaagaagccatcatgttcgcttttgaggccaacacgaagccaaagcagaatacagcagcatcgggacaaaaacaagcggtagtacagtaaggaaggggagaggaacatggggaaaccaactggatttatggagatcaaacgagaaaaacctgcggagcgggaccctctcactcgcttaaaggattggaaagaatattctgctcctttttcagaagaagcatcgaaacggcagggggcgcggtgcatggattgcggtacaccgttttgccagatcggtgcggacattaacggatttacatccggctgtccgatttacaacttaattcctgaatggaatgatcttgtctaccggggcagatggaaggaagcattggaacgcctgttgaaaacaaacaactttcctgaattcacagggcgggtatgtcccgctccttgtgaaggatcatgcactttagcgatttcagatccggccgtatcaattaaaaatatcgaacgaaccattatcgacaaaggatttgagaatggctggattcaacctagaattccaaaaaaacgaacaggcaaaaaagtcgccatcgtcgggtcgggcccagccggactggcgagtgctgaccagctgaatcaagcggggcattctgtcactgtttttgagcgctcagacagagcgggcggccttttaacatacggcattccaaacatgaagcttgagaagggcattgtagaacgccgaattaaattgctgacgcaagagggaattgattttgtcacgaacacagaaatcggtgttgacattacagctgatgagctaaaggagcaatttgatgctgtgatcttatgcacaggcgctcaaaaacagcgggacctcttaattgaaggacgcgactcaaaaggagtccattacgcaatggactacctcacacttgcaacaaaaagctatttagattctaattttaaagacaagcaattcattgatgccaaagggaaagatgtcatcgtaatcggaggcggagatacaggagctgactgtgtggctaccgctctgcgtcaaaaagccaaaagcgtgcaccaattcggcaaacacccgaaacttccgccagcccgcacgaatgacaatatgtggcctgaacagccacacgtctttacgcttgaatatgcatacgaggaagcagaagcaaaattcggaagagatccgagagaatactccattcaaacgacaaaaatggtcgcggataaaaacggaaagctgaaagagcttcataccatccaaatggaaaaagtgaaaaatgagcatggaaaatacgagttccgcgagctgcctggaacggaaaaagtatggcctgctcagcttgtctttatcgctatcggctttgaaggcacagaacagccgctgttgaaacagttcggtgttgattcagtaaataacaaaatcagtgcagcatatggggattatcaaacaaatatcgatggtgtattcgccgcaggggatgcaagaagagggcaaagcttaatcgtatgggcgattaatgaaggccgtgaagtggcgcgtgaagtggatcgatatttgatggggagttcagttcttccataaataaaggggattatcatataagagaaaccggtctggctgccagccggtttctttttttattccattacgatcccgatgtttccaaactgtctgccttcctgcattcttttatatgcttcacatgctttttctaaaggatatatccggtcaattacgggccgcagcttatgtttgtcaatgaaagcgagcatagcttgaaattcctcaccgcttcccatcgaggttcctaagacattgacctgaggaaagaatagagaacgcaccggaaaactgagattatcccctgagcttgccccaaagctgacaatacgggcatttggttttacatggcggaagtattccgaaaagagggcaggtcctatgctgtcaagaacaacatccgccttttttccctgcaactgctcatcccaattgctgtagctgtcaaatgcgtaatcagcacctaatttcagcgccttttttcttttctcctcactgcgggaggtcacgcttactgttgcgccaatcgccttagccataaataaagcgtaggttgccacaccgctgccgatgccgggtatcaatagatgctcgcctttttttaattgcccctttgtaaacagagctcgatatgcagttaaagcggataaaggtaaaacgcccgcttcttcccaagataaataagcaggttttttgattgcattttgtgaaggaatgatcacatattcagcaagtgttccgtccgaaggacctcccagaatctcaggtacaggtggaacattttctgtcaaatcccagttcaatgtcgggaaaatgactacttctgtctgaacagtaacatttttcacgccttcaccaatctcttcgatgatacccgcgccgtcagaacccagtatcatgtgaggatcttgttcagatttgtttttcataagaaacaagtcacgatgattcaggcctgcagattttaatttaacctttacctctccgtatccaggctttgttgatggaacgtcctcgactgataacccctgaaggccggcttttccgttgtgaattacagctttcatgctgtctgcctcctcattgaattgtattttcatatctttacatattttacatagcggttttcttcgagtaaaatgaacaaatatgatagccaatatcacttttcatcatagcaagcaggtgagagcgcgtggaaagcggagatttaaagatttttcaggctgttgctcgcgaaggaagcataacgaaagcagcccaaatgctgaattatgttcagtcgaatgtgacagccagagtgcataagcttgaggaagatttgaatatcaggctttttcatcgaacgaatcgggggatgaagctgactgctgcaggagaaaatcttttacaatatgcagatcaagtattatcgctgttagaccaagctgaaaaatcgacccgaatgagcaggcaaccaaaagggcctttgcggatcggatcactggaaacaatggcggtaacgcatctgcctgagcatgcagcatccttcctcaggcgttttcctgaagtggatttatcagtgaacacagctgatacgcatcatttgattcaacaggttcttgatcataaagttgatggcgcttttgtatatggaccggttgaacacgctgcagttagacaactccatgtctcccatgatgaattagttttgatttcatcacgagaagggacggcagaagacatgcttcagcagccgatgctcttttttggggctggctgttctcatcgtgacagggtcaaaagattactagaggagcaggcatacacaatcaaaaaatcatagagtttggcacattggaggctattataaaaggtgtttccgccgggatgggtacggcgctgctcccaaagtccgctgttgacggctccgagcatcgtacaaatgtatggattcatcagctgccaccatcatatcaagacttagagatcgtctttatatacaggaaagacttttttattacgagtgcgtttcagacatttcttgatgagataaacgaaatgaaaagatgaagatagacgtgcattagcagaataaagacgtttgtcagtttttattttaaagatgtgtataaaaaaactgtactcatttgaagcgagtacagtttttttatttatttacgttttaaattaatgccgatcgccgctccgtttctgcttgaatcagctacacctttaaaggtgccgttttcatggtcgatcgatatgctttgcacgtttccgatatccaccggacttgtgccgaatttgtggcccatcccgtttagcttgctgaggacatctttaggaactccgtcttcgtaacggtaagagctcatactgtttgtgtaaattctcggctcttcaacagctgcttttaattccataccatattcaatgtggtagagaatggtttgcaaaacggatgaaataattgtagccccgccaggagatccaacagtgaggacaggcttgtcatccttaaataaaatcgtcggggtcatgctgcttaaaggccgtttgtttggctgtacttcgttagctccgcctggtatcgcatcaaaatccgttaattcattgtttaggatgacaccgtaatcagggaccataatacccgttccaaacaactgttcgattgttgttgtataagaaacaacatttccccatcgatcagcaactgtaaagtgggttgtttggccttctactttgtctttcggctgttcaacttgtttatagtttgctgatccttcttggtatttccaagggtcaccggctttcggttttttattcacttgatctaggttgattaattgctggcgttctttaatataatcggggtgaagcaggcctttgagaggaacatttacaaattcgggatcacctgcataagacgcacggtcggcatatgacaaatgcatcgtttcagcaagcagctgatatttttcccatgagcggacatcgtattgtgaaaggttaaaatgatcaaggatttttagcatttgcaataagaaaataccgccggagcttggaggaggagtagtagcgatttgataaccttgatagtctccccaaatcggttcatcaattgtaatgtcgtaattttctaaatctttttctgtcattgatccgccgaaatcctggacagtgtcagaaagcgtcttggcgaattttcctttataaaaagcgtcagtgcctttggagcgaacaagcttaaatgttttagccaaatccttttgaataagggtatctccttctttaagcggttcgccatttggtaaaaatacatcttttgcggcagtccgtgaaagtttttcctgatattcagaaatggcatctgccaacaccgaatcaatcggaaagcctttttcagcgagtttaatagaaggggtaattaattgcttcatcgaacgggttccccatttatccaaggcttcttccagccctttcagagtgcctggaacaccaacggcagtaccttttgttacacgttcagagaaaggaattgctttgccgttttcgtccagaaacatatcaggagttgcgcctgctggagcacgctcacggctgtcgattatcgttgtatccttcgtttttccgtcatacaccatcataaaaccgccgccgccaatacctgacatcatcggctctgttacattgagtgcaaattgaatggcaaccgctgcgtcaatagcatttcctccttttttcagcacatcagcaccgatttcagaagcaagaggatgtgcggtcgcaaccatgccgtcttttcctacatctacttgtttgtactcatcgtagcttttgggcggttttttagcttccgcgtgaaaagggacacttccagcgactaacagaacactaagcagagctgttaaacagacgttccacgttcttttcatgttctccctcctatatgaagctgtattgttacaatcttagcgtaaaaaaattacagcgttttcacaagtgacaaatggtatattatatagtgcataatgccgtttttctgtgcaaaattgattatattgatatgagccatgtgctatattagaatcagcatacggattaagaagggactgctatatgtatttaacgattgaagaaacagcagaatatacaaatctttcagaggattatattaaaagcttggtgctcgaagggaaaatcagagccgttcatgacggagagcaatttttgatttataaagagcagttcaaaacgcatctcgaacagctggagaattacaaagcacttgtgcaggaaatattaaatgaaccaatcccggaagatattgatgtaaaggatgaggattaggacacaatttgaaattgtgtctttttttgtatatttttgcggaagctctagaaaattaggagtgtcagatttcgttttaagaggttttttgatgattagtagggggataagtatccaagaggttaaaagctttataagaggctttaaagcttattttatagggtgaaggttggaagaagcttttttaaaagcttatgtaacactatgtatattatgttacataaatgccgccgcactttgacattcaacgtttttcagctataatagtatcatagacctcaaaacgttacataactgtttttaaggagttttttgatgcatattgtacagccgattcgcagtctagagaaaatccaagaagtcaaacagtatttgcttaacaaaaacaagcgggattattttctgtttattttcggcatcaacagcgcgctccgcatttctgatattctgccgctgcaagtgaaggacgttcaaaataaagatcatttatgggcgactgaaagcaaaacgaaaaagaaaagaaagattcttattttagaatcgctgaaacaggaaatatacgagtatacgaaagacatgaaggaaaacgaatatctttttaaatcagtgcggaccaggaagccgatttcccgcattcaggcctacagaattttaagagaggccgctgcggcgtgcggacttgaggagataggaacgcatacactccggaaaacgtttggctatcatttttatcagcgaacgaaagacatcgccgagctgcagagaatactgaatcattcatcaccatcaattacaatgcggtatatcggtattgatgaagatacgacaagagccgcatataaggtttttggagggctttaatacaaatcgcttgaaaatattgatcatcagagctactatataaataccaaaagctctagtagcacagcggatagtgcagcagtttcctaaactgcaggtcgggagttcgaatctctcctagagcgttatattcacaaaaagacaacaggcacttttcgcctgttgtctttctttatgcagaccaaataaaaaacgcccgcttataccgggcgttattcttatataactgcgtcaaattgattgactttccattttttattttctttcacaaatgtcactttccgttttgcagaaggggatccgtctaatgtagggacggtaaattcgtatgtgattgtgctgccttttttagagatcagtttagcagttgattttttccaattcaaaagattgtctccgtcaccgattggaacagcaagttttccttttgaaacagtgaaatgataatctttaaagcctttttcgattgctgtttttgtaaaaataggagttaaataattcaccgcttttgctttagtgcctagatcactgcacatgtatacatattgaagattttgatactcgaatgtgcctgatgggcaaactgcttttttcaccttcggattgtggccgctcatggtgttccaaaaatgttctctagcggataatgccaactgtaatgcttgtttttgtgataaatcgcctgatgtatttttcgcaaatgcatttgtgcttaatgacagaataagtgcaatggttgttagaaatagaagacattttttcattatcgctctctccttcaaaatctctttctcttatgttacaaatgttacaataattacggatagattacaatacttttgcataaattattttttattcttttactcacaaaaaatacgccattacttgctagtttattcttcataagctaaaaagatgtgtaaaattagaagaatcgggaagggtttcatatgtgcagtgatgaataataacatgttacatatcctgtttttgtcaaaaaatgagggcatgtttaaaaacgatttcaaataaaggagtcctttaatatggaaacatcacaagaacctcttgtaactcaaaagaaaagcaaaccatcagtttggcggtcgatgtcactctttttagtgccgcttctgctgagcaatgtgctgcaatcagtcggccagctagtcgggatgatggctgtaggcagatggctcggtgttgatgcagtggcagctgtatcatcctttttcccgttattttttcttttaatctcatttacgattgggatcggttcaggaagttcgattctgatcggacaagcttacggagcgaaaaatgaggaacggctaaaggctgttgtcgggacgacactcacgtttacatttttattaggcgttgtgttagccgttatcggcagtattttcaccctggatatccttcgtttaatgggaacacctgaaaatgtcattcatgtcagcgctaactatgcacgtattttattttatgctatgccgtttatgtttttatattttgcatatactacctttttgcgcggaacaggagattccaagacaccgttttatacgctgattgtgagcacggtcatcaacatcgcgcttttgcctgttttaatccttggcatgtttggttttccgaaactgggcatatacggctcggcatatgcaactgtcatttccacgattgcgacttttctcgtgttaatggtgtatttacgaaagcgaaaacacccgctgcaatttgataaaacagtgcgtcgttatttgaaaatggataaggaactgctggttctcctgctgcgtcttggggtcccagcaagcatcaatatgattcttgtctcattatcagagatagcggttatttcattcgtcaatcattacggctctaatgcaacagctgcatacggagtggtcaaccaggtggccagctatgtgcagatgccggccgtcagccttggtattgcagtttctattttcgctgcgcaatcgatcggagcaaacgagtttgaccgcttaaagcaggtcattcgcgttgggatttggctgaattatatcattggcggcgtactgatcattctgatctatgttttttcacaccagattttgtcgttatttttaaccgagcaagagacgctttacattgcgcaccgtcttttgatgattacactgtggagctatttgctgtttggaaatgcccaaattatttctgcaacgatgcgggcaagcggaacggttttatggccgaccgtcatcagtatttttgcaatctggggagtagaggtgcctgtcgctttcgtcctttctcactatacaaagcttgaaatactcggcgtctgggttggttatccagctgcgtttgccgtcagcttgctgttgatttatgggtattatcaattcgtctggaaaaagaaacaaatcacacgtctcatccaatagcctcccaatcacaccgttcataagtttgaacggtgtttttttatttgataggggaaaatataaaatggaggaaatatggtacagtacattgaattcttatactagcaatgaatcaaggagaggttgagtaaacatggcaaactttattgagaaaatcacgtatttgggaacgccggccatcaaagcgggcaacgaacatctagaaatgattgttgtccctgagtgggggagcaacgtcatttctctcgtggacaaaacaacaaatgtccagcttttgcgtgaaccggaaacagcagaaagttttcacgacacaccaacattgtatggcattccaatcctgttcccgcctaaccgcataagtgacggtacattcagtttccggggcagaacgtatcattttgatatcaacgagaaggataaacacaaccatcttcatgggtttctttacgatgaaaagtggaatgtcgtgaccacgaagcaaactgatgaaggagtgattgttgaaacagaaattgatctttctgagcttccccatgtgcagaatcaatttcctcatcatgccgtcgttcggatgacatacacgatcaaggggaataccctatttaaacatgcgacggtcatgaacaaaggaaaggaagcgtttccttggggaattgggtatcatactacatttgtgtttccggcagaaagctcgttattctccctgacagcagatcagcaatgggagttggatgaacgcctgctgccgaccgggaaactgatggatgtaccgaataaagaagctttgcatgaaggaatggatttgcgccacaagcagctggatgatgtctttttatcttcctatcagaagaggggcggagaaaaccaggcagtcatttatcatcagcatgcacatatcagcattatttataaggcagatgaacagtttaaacattgggttgtatacaatgcggacggaaaacaagggtatttatgccctgaaccttacacatgggtgacaaacgctgtgaatcttgatttaccttcgtcactcactggtttacaagtgctggagccgggagaagaaacgacagctaaaagcagtatcaccattgaactgaatcatcaatagccaatgatgaagcgcagagaggcggggaaattaatgaaaaaaagcataaagctttatgttgctgttttactgcttttcgtcgttgcttcggtgccttatatgcatcaggctgcgcttgccgctgaaaaacaagatgcactttccgggcagatcgataagattttagctgatcatcctgccctcgaaggcgcaatggccggcatcaccgttcgctctgcggaaacaggtgctgttctatatgaacattcaggagacacccgaatgaggcctgcctcttctctaaagcttttgacagcggccgcggcactttctgtccttggcgagaactattcttttacaaccgaggtccggacggatggaacactgaaagggaaaaagctgaatggtaacctttatttgaaagggaaaggcgatccgacacttttaccatctgattttgacaaaatggctgagaaattgaaacattccggcgtaaaagtaattaaaggcaatctgatcggtgatgatacgtggcatgatgacatgcgattatcacctgatatgccttggagcgatgaatacacatattatggcgcgccaatctccgctctaacagcgtctccaaacgaagactatgatgcaggcactgtgattgttgaggtcaccccaaatcaaaaagaaggggaagagcctgccgtgtctgtctctccgaaaaccgattatataacgataaagaacgatgctaaaacgactgctgccggttcagagaaagacctcacaatcgaaagagagcatggaacaaacacgattacaattgaagggagcgtaccggttgacgcaaacaagacaaaggaatggatttctgtctgggagcctgccggatatgccttagatttatttaagcagtcactaaaaaaacaaggtattactgtgaaaggggacatcaagacgggtgaagcacctagttcttcagatgtgctgctctctcatcgctcaatgcctttatcgaaactttttgtgccgttcatgaaattaagtaataacggacatgccgaagtgctcgtaaaagagatggggaaagtgaaaaaaggagaagggagctgggaaaaggggctcgaagtgttaaacagtacgcttccggaatttggtgttgattctaaatcactcgtcttaagggacggatcaggaatctcacatattgatgctgtatcctcagatcaactttcacagctgttatatgacattcaggatcagagttggttctcggcttatctaaattctttacctgttgcggggaatcctgacagaatggtgggcggaacgctgagaaaccgcatgaaaggcactcctgcacaaggaaaagtaagagcaaaaaccggatcgctcagtacggtaagctctctatcggggtacgcagaaacaaagagcggaaaaaaacttgttttctctattcttctaaatggattgattgatgaagaggatggaaaagatattgaggatcaaatcgctgtcattttggcaaatcaataatagcggcagacctgttttccaagagaaaacaggtttttttatgtctgtaataacgctttgtcgaaccttccaacaattagaagaatgatgcacaaaagaaaattagtccgattaaaaagtagtgtataagaccttatgtaaaacaatacttttatcactttatatccggaaatttgataaaaaaagaaacgaaaaataaagaaataatactatattcaaaaaaatgttataaaaatttaatgttttttattgtactttaaaaaatatccgttaatatagtgcatatatggattatatagtcatataatttcttttattgtcatttttctgcttttttctacattttcttatcctcttattatgagaactggagggaatccgttgagcgaacatacttattctttaacccatgcccaaaggagagtgtggtttaccgaactgctggagccagataccagcatttgcaatcttacagcttgtgtgaaattcaaaggcaatattgagcttgatactctagagggagcgctgaatcattccatctcccgcaacgacgccatcagatttcagctgttagaaggagaagagcttgagccgcgattgcaccttactgaatataaatattatccacttagaataattgatttttcaaatgttgaaatgatagaaatagagcaatggattcaggatcaagcgagcattccatttaaactgttcaactcgcctctttttcaattttacctccttagaattgactctcatgaagtttggctatttgcgaaattccatcatatcataatggatggaatctctttaaacgtgatgggaaatcaaattatagatctttatcaaaaaatgaaaaagaaagatcctttacctgatcagccggaaccttcttacttgagctacatcgaaaaagagagtcaatatctacaatctccgcggtttgcaaaggaccgtttattttggacacaaacctttgagcacccgttggaataccactcgttagccgaccagacgtccttacaaaaacagagcacatctgcatccagagacaccatcattctttcacctgatctagagcaaacgattcgaatcttctgcgaagaacacaagatcaatatcatttccttatttatggcttcattttacatatgcatcagccgaatcacttctaaaaaagatcttgccattggcacctactatggcaacagaggttcaaaggctgaaaaagaaatgctcggcatgttcgttagttcccttccaatcagaataacggttgatcctgacacagattttctttcctttgtccgcacaataggcagggaacagctttctgttatgcgtcatcaacggtttccttataatttgcttgtaaatgaattaagaaatgaacagaaggatttacacaaccttatcggtatatctatgcagtatcagccacttcagtggcacaatgcagatgattttgactatgaaacagcgctttatttcagcggatacaccgcgaacgaactttcagttcaaatacaagaacggatagacaatggaaccattcaattaaatttcgactatcaaaataccttgttttctcttgaggatattaaacgaatacaatctcatctgcttaccatactggaaaacgcccttaaacatccgcacagctttataagagaattagatatgacgaatacaagagaaaagcaaaaattgttgtatgagtttaacaagacggaagctgtttcgtctaaagctttcaccctgcatgggctgtttgagcgacaggcagctttcacaccggagcggctggccattcgcttttcaggcggttcgctgacatacgctgagcttgatatgtacgccagccggctggctgcgcaccttgcggcacgcggcgtcacaaacgtcgttacttctcaatgaagcagctttactaatataacattcagcttcttttttgtcaataactttttcaagttgttttgaagcatctagtttgtgtccgctgtgcatcagcgacgtttaataatataacacctgtatttatttattgcaatagtttttttaaaaaaatctataaaacaaataaactataatcctcgccatgatttctaaagcgtgtgtatcatataactttcttaaaagaacatatacatcagtcatgtgatcttgttgtttttttcgttttcttgtatagtagaaacgaactaaatactgatgaccacaaggggagcattaaagctgagagtgagcggtatcgttctgaccctttgaacctgttagttaacgctggcgtagggatgtggcaaagtcaaatgaattgcagctcgtaaagcagtgcgtggaacttttctcatccttccgcgtgctgcttttttgttgtccttttggttgtctgtcaatggaaggagatagatatgaatcaatctaagcaactggttcgccttattgaaattgccattatgacagcggcagccgttattttagacattgtctcaggaatgtttcttagcatgcctcaaggaggctcggtctccatcatgatgattccgatctttttaatttcgtttcgctggggtgtcaaagcaggtcttactacaggtttgttgacaggtctagtacaaatagcaatcggaaacttgtttgctcaacatcctgtacagctattgttagattacattgtcgctttcgcagcaatcggcataagcggctgtttcgcttcttctgtccgtaaagccgctgtatcaaaaacaaaagggaaattgattgtttcagtggtcagcgcagtttttatcggcagtttgctgcgctatgccgcgcatgtcatttcaggagctgtgtttttcggcagctttgctccaaaaggaacaccggtatggatttattctttaacttataatgcgacttacatggttccttcattcattatttgtgcaattgtcctatgtttattatttatgacagcaccccgtctgcttaaaagtgacaaagcgtaaaagtaacaatcccccagcgaattccgctgggggattgttcgttatctgttaagaagtgtttttaaagctgaaagatccggccagccaagacctacttctttcagccttactccggcaatttcaaagttgtcctccgctactctttcaggtgaataggcctgataaaatataattgagggattctgctcaataacccaaacaaacatacttgaaaatccatgttgaagcaaaaactccgctccttttgctaagagcgccctgcctgcaccttgccgctggcgctcttccagaagataaatagcgtataactcgccgtcatagccttcttgttcagagcgaataggtccaaatgaagcaaagccgaatactgaatccatttcgtcctgagcaacaaatactccttttaacgagcgacttttccatttgtcttcaaattccttatagttcaggctgtttaaataatcaatcgggataatttcgtggtatgttgtcctccagctgtctacatgcacttttgcaataccctttatatcctctaacttcgcttcacgtacagttaccatacggttctgtcctttccttactctgatttttggaccgttttggcttctttgatttcatttgttaattcattgatgctttgttttacgtttccttttcctgaaaagttctcaagcatttcttttacatcgattcccgaggatgcttttaaactttcttgcagacttgacattaagttcgtcgcatagctggttactttgtttgctccgcttgattcaccgcttcctcctgtatcgacaacggtgattttatcaatatttgaaagaggtgccgctgcttgtttcgcgtattccggaagcattttgacaatcatatcaaaaatcgccgcctgcccgtactgttcaaaggcggccgcaattttctcttttgcttccgcttctgcaagacctttcaggcggataacctctgcttctgtctctcctttcgctttttccgcttctgcttttgctagcccgtcaattcttactttttccgcctcagcctttgccattgcttcaatactgtacttcttggcatcggcttccgcgagctgtttggctttctcagctgctgcggactgctcaacagaataacggtctgcatcggcttttttctttacctctgagtcgtattgacgttcacggcgaagaatttctttttcttctagttctatttgtttttggcgttcgataattttaacctgcatttcctgctctgtgacttgctggcgcgctcgggcagtctctaaatcatatgcttggtcggcattcgcttttgccgtatcttgttctctgcggaattcagccattttgagctgattgagtttttcagcttcagcgatttccgtcgcccgttcaagttctgatttttttgcgtctttatcggcttctgcccgcttaattcgggtttctttatcagcctctgctgttgcgatatcagcatcgcgttttacttgggcaattctcggtttccctaatgattcaagataaccgtttttatcacgaacatctttaatggtaaacgagacgattacaagccccattttcgcgagatcctgtgaagcgacacgctgcacctcttgagagaatttttctctgtttttatagatttcttctactgtcattgagccgagaatggaacgaaggtggccttctaaaacctcccgcgcttcctgctcacggtcgtcttttgatttccctaaaaattgttcggccgctgtagcgatttctcctatagaaccgccgattttaataatcgcagttccatcggccattactggcactccttgttctgtatagacttcaggtgtcgaaacatcgagtttgcttgataataagcttagcggctctgcctgctggaagacgggaaggacaaaggttcctccgccgcggacgattttaatacggttgccgccttcatcgacatgaacatttttattgcccagatagctccctgttacaattaacgcttcatcaggccctgctgtacgatacttcgtaataaacacagctattagtgcaattaataaaaagaatacaactccgatgatcattataatcggcattgtcatatcaaattcctccttgtatgttaaatgggttcatgcggagtaaccgaaagaactccgttgttaatatctacgactaacaccgttgtcccgtaactgatctgctgattatcaaaactgaccgctgactttgaaatggtcccgcctatcccttctatgaccacttcaccaaacccgtcaaccggcacagctgtaatcactttaccgagtcttcctctgagatcatcttctctatatgccaatgattcttctgcagatgataatggtaccagtacaaagatgtgaagcaataccaccagcatgattgaaaggatgcaagataaaagcgcaatcagcaagctcgacagaggcaatacgagttcacctatatatccgcccgctgaaaaacatgtgaaaaatgagagcactaatgtcggattaagaaacggaatgccttctggcagccctgcaaatacatctccgaaaaacaggaataacagcgtaaggctgcccgcaataataagcgtataaagatacattgtttgtataggtactccaaataactccaatttcctcatcctttcttcatcaatgcattgatgaacggctgccgttaccatttatacgagactccccgggaaaagtttcaaaattttaagacaaataacccgtttgaagtgctttataaatgataattgcttatatatatggtaatgtcattttaggaggagatatgatgagtatctttaatgaagccagattagaaacgtggaacgaattgaaaggactttctgacgaaaagctgaaccaaaagccttctgctgaagaatggagcatacgggaagttcttgaccatttgaaaaaaatcgatatgaccgcacaaaaaatgttgaaggaacgtgtaaaggacgctccgattaaagaaattgaagaaaaaccgcttgaggtagcacaggacagaaataataaacggaaagccccgagtcatcttgagcctgcgcatgattttatttcaggcagccaaatgaaacgtgagcttaatgtggtaagagagcagctgactgctgcgattgcctctctgaaagaagaagattttgaaagagtgcttccgcatcccgtgtttcaagagctgactgtcagacagtggatcgattttatcggccatcatgaaaaacggcacctcagccaaatgaaagaaattaaagaaaagatagaaagggcctgatttaatcagaccctttctgcttttcgtttgacttttcgctgataggaatgaacttctatttcatcacctgtgtaaacagcaccaggtctctccacaatacagacaatccctctaatgcccagtgcgtggcggacgaaagccggcgccagcttcggttggtccggataataagactgaatgacttctcccggctggatacacggatcattttcgccctcacacagcagagccgctccgctcggaaaaataatccggcttccttcttttaatgaagtaagatctggcataccgctgactgccacattcgccccgagccattccggcaaaattctcggcactcccatttttaaagcgatttcgttgcattcctctattgaaacaattgaaatttgtctgcggttgaaaatttcagtccctcttgaaaacattggttctctggctcccgcttttttggtcaggccaaaatgcaagtcgccggggatgccgccataatcaaaatcaagcttgtccatttgctttgttacgaagctttttgtatctgcgatatataagccttccgcttttgcagtcatacgcttccacatcagctggcaccttctttcttatctaaaatttccacctatgcttcattatcccaaaaaatcccgctctgtaaaggagcgggattttgattataccgttttaggcgtaaggttaaagcagcgcttgtagatccagttgtatgctttttcatttaaatctctagggtttccgaaggtttgcggatctttcattgcttctttagacaagcgttcgatcatatcaggtgatactccctgctcttctaaagtcggcacttctaaatcttcgaccagatcatacatccaattgacagatgctttcgcagcttcttctgttgtcatcttgcttgtatcaataccgaacgctttcgcaatacgcgcaaacttctcaggatagcccttccagttgtattccatgacagggcccatcatcgccgctacacattggccgtgagcgactgggataataccgccaagcgtttggctcatcgcatgagccgcgcccgctgattcacttccgtaagaaagaccggcaagcatcgctgcctgcgccattccgtacctcgcttccagatcctctccgtcagcaaatgccctcttaatgtaatgagcggcatactcaatcgccattagggcaaccgcatccgtgattggctgtgcaaatttcattgtatagcactcaatggcatgggcgagcgcatcaattcccgtcatagctgttacatgcggaggcattgaaacatgaagctcaggatcaatgatggtcaagtgcgctgcaatcagcggaccgcccgtgttgaatttgaattctctttcttcatctgtgataaccgcccattgggttacttctgatcctgttccagctgtagtgggaattgtcgtcagcggaggaatgcggttttccagcggttttttcccatctgccgcttcataatcaagcacgcttccttcgtgagtcgcttctactccgattgcttttgctgtatccatggagcttccgcctccgactgccaccaaaccattacagttctcttttttgtaaagctcagatccttcattcaccagacggacaggcgggtttggctcaactttattaaagagcaccacttcaatgcctgcttctttaagtgattcgattacaggatcagcaacaccggctttataaatccctgggtctgtgacaaggagcgcttttgatacgcccagtgcagctacttcctcacccgtatgcttgatggctccgattccatgcttaatcacagtcggaatttcaaatgtgtggaatttctgcatgctttctaccttcatatttaatgtcatcatcaatctccccctcttatgaattaaaccagttaaccgctgccggttttgtattgcggtatacatgtttgacttctgtgtattcttcaaggcctatctttccaagctcgcgtccgaacccggattgcttatatccgccccatggcgcttgtgcaaagtacggatgaaaatcgttgatccaaacggttcccattctcaagcgggctgctacccgttcgcacttttcaatgtcttttgaccataccgctccagccaagccatagatagtatcattcgcaagctcgattacctcttcttcagagctgaaggtttcgactgtcaatacaggaccgaaaacctcttcctgaacgattctcatgtcagaattacagtttgagaaaatagtaggttcatagaaaaagccgttttgaagcgcaggatcttccgggcgtttgcctcctgtctccagcttcgcgccttcctctattccgatctctacatatttttctacctttgccctgtgctcagccgaaataagcggaccgctttctgtctcagcatgaaaaccgtttccgagttttatgcgttttgcccgtttgaccagctccgccaaaaattgatcatgaatggcatcctcaacaagcaagcgggaacctgcagagcatacttggccggcgtggaaaaatacagcatttaaggcctgatcaaccgcaacttctaaatccgcgtccttgaaaacaatatttgggtttttcccgccaagttcaagggcgatttttttgacgtttccgcttgccgcccgcatgatttttttgcctgtttcaattccgcccgtaaatgaaatcaaatcgacgtctttgtttacggcaagctcgtcgcccactgtggctcccggtccaagaacaagatttgcgacaccttttggaacaccggcttcttccatcagcttaaagactttgattgtcgtcagcggcgtaatctcactcggcttcatgacgattgtgtttcctgcggccagtgcaggggcgattttccagctcgcttgaaggagcggataattccatggagtgatctggccgcaaaccccgattggctccctaataattttgctttctgaatcaggaatcggagatgaaatgatctctccgccatctttgtctgccaagccggcgtaatattgaaaaacattggcgatatcgtccatatcggccttgctttcttcgagtgtttttcctgtatcaagagattcaagctcagccagctcctcaagatcgcgtctgattaattccgcaattttcagaacaattttcccgcgttcaagcccggatagcgcagaccattctcctttgtcaaatgctctgcgtgcggctgcgattgctttgatggcgtcctctcgccctccctcgcttacagttgcaatttcttcttgattaaatgggttgataatactgcggatctgttctttttcggcactgatccattctccgtcaatgaataatgtttgactcatataagcctccttgacgtaaataaagtttgttaaataaaaatttaatgtttttaacaaccttaatctaacacatggtttttaaactgtcaaagtcccatttcgatttttctttttgacttttcctcatgtttggttaagataaagaacataaagaaataacttaacgaatttaattttctaaaggaaaagagggtcagtatggatgaaaatccagaatttgcagctatagaacaggctcgggatcttgttattgactccattgctgaaacgatggatctttacggaattacccgcagtgtcgggattttatatgggacgatgtatatgagggatgagatgacgcttgacgaaatgcgtgaggagctgcaaatgagcaaaccaagcatgagcacaggcgtcaaaaagcttcaagacttaaatgtagtgaaaaaaacatttcaccggggcatccgtaagcatacatttgtggctgagaaggatttctttaaatttttcacaaatttctttccgcctaaatgggagcgggaggttcaagtgaatgtagcagcgatcgaggaagctcaagctgatttacaaaaggttttatgcaaggaagatctcgatgaggatatcaaaaatgaagcactgcagttatatgatcagctggaaagctctaaagcttactatgactggctgaaacggcttgctgaatcggtgcagaccggagaaatttttaaatttataccgatcgaaacaaagtaaagcagaaaacgcctgggaaaccaggcgtttttttgatgtaactactacaaatttgaaaaatacgggaaaaacaccccatttacttccaaaatatttgatggtaattttatgtaggtaaaatttgtatttggcctttcagaggaggtgaaaagcgggcaggcctgtttaatttatcattttttagggggaattttgttatgaaacgcaaattattatcttctttggcaattagtgcattaagtctcgggttactcgtttctgcacctacagcttctttcgcggctgaatctacatcaactaaagctcatactgaatctactatgaaaacacagtctacagcttcattgttcgcaacaatcactggcgccagcaaaacggaatggtctttctcagatatcgaattgacttaccgtccaaacacgcttctcagccttggcgttatggagtttacattgccaagcggatttactgcaaacacgaaagacacattgaacggaaatgccttgcgtacaacacagatcctcaataacgggaaaacagtaagagttcctttggcacttgatttgttaggagctggcgaatttaaattaaaactgaataacaaaacacttcctgccgcaggtacatatactttccgtgcagagaataaatcattaagcatcggaaataaattttacgcagaagccagcattgacgtggctaagcgcagcactcctccgactcagccttgcggttgcaactaatgtaaaagaccggttaacgccggtcttttttgcgttttaccctcccctttttctctaattcccgttatcttttttctggtttaaaatttaaattgacaaacactagaaacaggagtaaattcttgagtgttcaatttcatacagtctcttttaccgcttaatcaaacacgaacgggggaaccaacgattggctgttttattaacagccttggggtgaatcttactaagtaagagggggtactctgaatccctaatccgacagctaacctcgtaggcgtatacagagaggaggtctattatcggccattctttgcaatggtcttttttgcttcaaaaacgttaattcactaagggagatatgaacattgggaagaattaaaaataagcaatttgccgtgatcgggctgggccgatttggcggcagcatttgtaaagaacttcatagaatggggcatgaggtccttgcggttgatatcaacgaagaaaaggtcaatgcatatgcttcttacgccactcatgcggtaattgccaacgccaccgaagaaaacgaattgctttcattaggaatacgcaattttgaatatgtgattgttgccatcggagcaaatattcaagcgagtacgctgaccaccctattattaaaggagcttgatgttccaaatatttgggtgaaggctcaaaactattatcatcacaaggtgcttgaaaaaataggcgctgaccgcattattcatcctgaaaaagatatgggagttaaaatcgcacaaagcctttcagacgaaaatgttttgaattacattgatctatctgatgaatacagtattgtcgagctgctggctacgcgcaagcttgattcaaaatcgattattgacctgaatgtaagagcaaagtacggctgcacgatcctggccattaaacatcatggagatatctgtctttcccccgcgcctgaagacatcattcacgagcaagattgcctggtgatcatgggccacaaaaaggatattaaacgttttgaaaacgaagggatgtagacaaaagtgacacttcaaagggataaagtgatcaaatgggttcggtttacaccgcctcaagtgcttgccattggttttttccttaccattatcatcggggctgtcctattaatgcttccgatttccactacgaagccattgtcatggatagatgccctttttactgcggcttccgctacaactgttacagggcttgctgttgtcgataccggtactcaatttacggtattcgggcaaacagttattatggggctgattcagattggcgggcttggatttatgacatttgcggtcttgatcgtcatgatattaggaaaaaaaatcggcttaaaagaacgaatgctcgtccaggaagccttaaaccagccgacaatcggcggtgtcattggccttgtcaaagtcctgtttctgttttcgatcagtattgaattgatagcagcactcattttatccatccggcttgtacctcagtacggctggtcatccggcttgtttgcaagtttgtttcacgcaatttctgcttttaacaatgccgggttttcgctgtggcctgataatttgatgagctacgttggcgatcctacagtaaacctcgtgattactttcttatttatcacaggagggatcggatttacggttctgtttgatgtgatgaaaaatcggcgttttaaagctttttctttacatacaaagctcatgcttacaggaacgctgatgttgaatgcgattgctatgcttacggtctttattttagaatacagcaaccccggcacgctcggccacctgcatatagtggataaactgtgggcgtcctattttcaggcagtgacgccgagaaccgcaggcttcaattctctagattttggaagcatgagagaaggaacaattgtatttactttattattgatgtttatcggagcaggaagcgcatcaacggcgagcggcattaagctgactacgttcatcgtgattttaacatctgttattgcttacttgagaggtaaaaatgaaacggttattttccgccgttccatcaaatatccgattatcattaaagctttagctgtgagcgtcaccagtttgttcatcgtgtttttagggatttttgccctgacgatcacagaacaagcgccatttcttcaaattgtgtttgaaaccttttccgcattcggaactgtcggccttacgatggggcttactcctgaactgacaacagctggaaagtgtatcatcattgtcatcatgtttatcggaagaattggccctttaacgttcgtgttttcattcgcaaaaacagagcaatcaaatatccgttatcctgatggcgaagtgtttacagggtgatatcaaaaaaatccgacgtgcagtcgccggattttttatgattcaatatgagattgattttgtcttttttcctgttccgcgatgatttcattatcctccgcgttatcacgggttactttttgtgtaagaatcgcaccaactgctacaagtatcataacagcgatgtaataacctttttcattgagttccaggttatcagcattatagagtccgatactaaacaaaaatactcccgcaaaaaaagtaaaataagctaatactgtaaaggcaaccgtgtttctgcgtctatatttctgcacctttgttccctcccgaaagcatagttaaaaagtgataacttccgtggaatattatacctcaaattccccgtaatggaacaaagaattaaaaataccagtaaaaagggcttaggttgcctcctttatttcaacagctgaatcatcaatccagccgataagtttatcattgatttggaattggtaccatacagactggcctttctgttttttagacacaacctttatgtctttgccgacgtaagattgggcagaggtaagccttatggaccgatcatcagtagaaggcttggaccatacgtcttgaacggcactgtctttaatagaggcgtttaaatccacagatttgagggatggatttacctcatcgtactcatctaaatcgtatttttccacaatagcgctgattttgtcagcatagtcaggatctgtagcatatcctgatgtttgcagggcggttgccgcttccttataattccctgcctcaagcaccggtttatacttctttttattccaagatgtgccacggacgaacaattgggcgtgatcatccatagattcaaaaaacgtgctgtattttcgaaacttcgcgcgaatggtttttcttttccctttttcaacttcgtccgtttccatcgtgacatgatggcctttataattcccttttacgccaaaaaggttgttggccttagcagccagttcactgttcccccagtccgattcgagaatggcctgagcaattgtgatgctggggagaacatggtatttttcatacaaaatttgggcatgtccggacagactgtctataaatacttgctgttcatcgatttcttcagtttctttggatatttcaatcggttttgataaagttgtcgctaaaacaaacagagctagcggaatcgatacaaggaaaaatagtgaaatcaagagtttacgttttttaagttttttacgggccatgaaaaccttccttcgaattaaaagattacgaatgtaaaagaatctaccttttagaattttacttgcacttctaatatttttcaattctttagggataaagttgggaaaagattgcaaaataaaaaccttttcgctcaatgaaaaggtttttaccatgtttctatttttgtaaatttctgagtgcattccgatattccgtatcatttattactttatatgatttgacagttgccttcgacaaaccttctgctgaaacggccggtttttccggagctgttttcgctttatcatgtggtttatgtgccagcttgtgccccattccagtggcattcatacaaaatgacaggcagacgagcagcacgctaaggataaaagaaatgaagaagagatcatgataagcagtcatcatagaatcctgtaccgaaccgctttgtctggcagcatcttttttcgtgaaaaagccgatgagaataggaactcccatatagacaaacaatcttaaaaactgaacagctgtcattctcttgaccaaatcaggcagcgggcctcccatggcagctcccatcagccctgcggcgactgtcaggcctgttcccgctgcaagcatgataaacagtgccgcgaacatataaagagatgatcgatcctgcatatgcagccattgaaaattcacaaagacgagaatgagtccgccgataataccgagcatccctggtccgactttatcataaaacagagtgctcaaaatggccgcgatcgccactccgattaaaagagtcaagtttaaaagaatgagatgctcctgagaaatatcatacatttgacggagcaagccttgaaaagcagacaggctgacagctaccgttatcgtccctgcagctatgatcaataagccaagcaccggttttggcagcagcatcagtttaatagatatgaatgggtttttcactttatattccacaatcaatagaccaatgagcaaacataacgtcaccccgaaaccaatccatacataacccgatgacagcccccatttttgcagaaaaatgaatgaaaccgctgaggctgcggcaaggaaaacagataaaagaattcccgcacgatcaagcggctgttcttgatccgccgctccgtgatgttcgtcatggagaaagaaatagctcaccgcgacaccgatcagggacaaggtgccaaagatgaaaaacagccatctccaatgcccgcagcttgttgcaatggttcccaggattgtgccgatgataacagaaccatagaatcccccgatcagcacaagcagtgcataattcctgcgttcaatcgggaatgacagtacaagcattggaatcataatcatcagcatgacacctgttgccgctccctgtaaaaagcgtcctgccgccatccatgcaacatcgcttgaacatgcgatgagcagtgaacctagtataaagacaggtaatgaagccagatagacgggacgagcaccgaattttttcctcagcagcggtcctgccggaactaataaggcaaaggccatattgccgatcaatattggatttactgatgtgaagccacttgttccaaccgctttctgaacaaggccttgaactgacgacaatgccgtgttagacatcaatcccggcccgaccgctaagacggcaagcaaagaaatcacccaatagtgttttgtcttcatgttgtcattccttcctatatgaatacatgcgaaacacatcattttttgaaaccaaaagaagctaatagattttgcataccattagctttcagtctaatattctccctttcaggggaaatgatattattttattataattatgtgaatgaatgagcatataatcaaatattatttcaaatcgattgtgttttgtcaatggagtaaatttcaagcacaacataaaaagtctgaaagcttttccccgatattgtgttttggagccaaggggcctagaactgcacttatggagccctgctcgttccctcaagcgaattaaagcaggccgttttaaccctttcaatccactattccaactaataaactcgaataagttgtgataagacaacattttggccgcacatttttttgtgttcactgggcgtttgccgcctctaaattgtatatgggtaaataccatgaattaacctatgaaataccaatgtaaggaaattttaaatattccgggaggcaaaaacgaatggaactgtatgagtgtatccaagacatttttggcggcttgaaaaatccatcggttaaagatttagcaacgtctttaaaacaaattccaaacgcagcaaaattgagtcaaccgtatattaaggaaccagaccagtacgcttacggccgaaatgccatctatcgaaataatgaattggaaattatcgtgattaacattccgccaaacaaggagacaacagtccacgatcatggtcaatccattggttgtgcaatggtgttagaaggaaagcttcttaattctatttatcgctcagccggcgaacacgcagaactctccaattcatactttgtccacgaaggagaatgccttatttcaaccaaaggtttaattcacaaaatgtccaatccaacatccgaacgaatggtgtctcttcatgtctactcccctcctttggaagacatgacggtctttgaggaacaaaaggaggtattggaaaattcatgattgacagataaactgctcactttgacttcactcaactggaggattcagagaatgaaaccttttcctcaaaacaaaaaaacccttatagaataagggtttaaaggtatggagccaagggggctcgaacccctgacctctacgctgccagcgtagcgctctcccagctgagctatggccccgtatgtaatgtcatgtttattatagatgattttattttgaaaaacaagctgtttcctcttgaattgacagaaaaaataaggctcgtaaaagagccttattttcgacttacatcatgatcaaaagtaaaatcacaccgagaataattcgatagattgcaaatgggacaagtttgattttgttaatcagccttaagaagaaacggacgacaaacagtgcgacaacaaaggcacagataaagccgacgatgaaaaatggcatcagatccgagcttaagctgtcccaatgcttcacgaggcttagaaagctggctcccatcatgatcggcatcgccataataaacgtaaagtcggctgcagctcggtggtttaatccgagaataacaccgccggaaatggttgaacccgaacgcgagaaacccggccaaagggcaagacattggaataagccgacggctatcgcctgtttataggaaatgcggtcgagtgtgtctgtcgctgttttccgtttattgacccagtcagcaaaaagcatgaggattgccccggcaattaaaccgatggccacagttttaacggaaaataaatattcatcaatgtaatcttcaaacaaaaagccgagaacagctgcaggcacgagtccgacggcaatttgggcaatgcttaatttatgtccctgctcctggtcgcttgtaatattttttttcaagcccagtaaatttaaaattcggtctttaaacacgatagctactgctaaaatggagcctagctgaataaccaccttgaatgagttagcagcttcttctgacatcagattacttgatttaagccagatgtcgtctactataatcatatgtcctgtcgaagaaaccggcgcgtactctgttaatccttctacgattcctaaaatggcggctacaaacaattcccatagagtcatgattttgattctccccattagacatttatttttttacataacgggagcttcccataaatggaaagcccgtcttatataactataaacgaaaatcacactttatgccccggcgtattttcatttttttcttcatcgtataaatgtgaccgcattttaaaccagtcaaataaatgtgtcgtaatgactttggcaaccgcatagccgggaatcgcaagaatgattccaacaacgccgaacagcttgccggctgttaacagcagaaaaataatcgtaatcggatggatgtgaaggttttttcccataatttgcggagagatcagcttcccttcaatcagctgaacaatcgtccaaacaatcaccagcttaagcagcatgagcggcgatgtcactatggcaatgataatcgcaggcgtaatggcaatcgttggccctaaatatggaacgatgcttgtgcaagccgcaatgactgcaagcaatgaagcataatccagcccgataatcaaataaccgataaacagcaaaaacccgatacagaagctgacaatgatctggcctctgatataagagcttaaccgatgattcatttcgcttaagactgtatatgtctgttctttcaatcgagtcggcacaaacttcagtatgtagaccggtaattttcttccgtcttttagcaaataaaatagaataaacggaaccgtgacgatcgaaatgataatctcagtcagtgcgccgataaaattcccaacaccggtaaaggtgctgttcacgatcgtcgctgcctgatccgaaacctttgtagcaagatcagatatattaatgttcatcgtttgctgggcctgattgacgaagttgctgccaatcagctgtttcgtctgattttctacgacgtccacatatctcgggatattgtcaatcaaactcatgatttgttcttttaagaagggaatgatcgacacgatcgtgatcgtgatcagcccgataaccaatagatatagcagcaatatagaatagattcttcttattcttcttctctccagaaaatcgacgactgggtttaacagataaaaaacaatgcctgtcaaaataatcggaagtgatatcgttttgagcagaacaataatcggggtgaaaataaatgatgtttttgtaaatactagaatatttaaaccaatcagcagcagcacaagcaaaaataaaacaaacttattatccaagaagaatcgcttgaatctgccgctccatgtttgcaacgtctccactatcgttcctccgtcatacatagtttaattaaattgtacactatcgtccctataatgaaaaataaaaaccgttaattgctggaaaagctttcacggttttaacattctatttatatctatcatgtgattttgttctttttaagctataatttagctatatcatacaaaaggagcgatacgagtgatacgttttgcaataataggaaccaactggattacagaccgctttcttgagtcagcagcggatatcgaagattttcagctgactgctgtttattcaagatcggctgaacgcgctggcgagtttgctgctaaacacaacgctgcgcatgccttctcagaccttcaggaaatggcggcgagcgattgctttgatgccgtatacatagcgagcccgaacgctcttcacaaggaacaagccgttctctttatgaaccatggcaagcatgtgctttgtgagaagccatttgcttcgaatacaaaagaaacagaagagatgatctcagcggctaaggcaaacggcgttgttctcatggaagcaatgaagaccactttcctgccgaatttcaaagagctgaaaaaacacctgcataaaatcggcactgtccgcagatttaccgcaagctactgccagtattcctcacggtatgacgcgttcagaagcggaactgttttgaatgcgtttcagcctgagctttccaatgggtcattaatggatattggcgtctattgtatttatccggctgttgtgttgtttggcgcgccgaaggatgtaaaagcaaacggatatgctttatcctccggagtggacggagaaggaactgtcattctgtcttacgacgggttcgaagctgttctgatgcattccaaaatctctacttcctatgccccggctgaaatccagggtgaagacgggacgattgtaatcgatacgattcaccggcctgaacgtgttgaaatccgctaccgggacggccgccttgaaaacatcgcgatccctgatcctaaaccagcgatgttctatgaagcagaagaatttgtcacgctcataaaagagaataagctggaatctgaagaaaatacatttgaacggtctttgaccaccgcaaaaattatggaagaagcaagaaagcaaatggggattgtataccctgctgatcaagcttaaaaaaatccgcacgcgcgcaaatgccgcggcggattttttattagacaatcggagaagatgccttcctttttaaaagcacctgttgttcatattctttgatgtcatgaagccatgcttcttttaccggaacgcccatttgctcacagtaggaatcccagatggctccgaaaggatatgttttgaattcctccatcagggccagcctttctgtatagcggccctcttcctgcaattgttttaaatatccgttcgggagaagcagggcatacaataaagctttgatcatatttctcgttccgatagtccaggcggctacacggttaatgctggcatcgaaaaaatccagaccgatggcgaccttctcaagagcatgatttcgtacaatttcaagagcgatttctctcaattcatcatccaaaaccactacatggtcgctatcccaacgaacaggccgcgatacgtgcaaggcaagcttgtctgtgtaaagcagcatggacgagattttgttcgataccgtctcagtcggatggaaatggcctgtatcaagtaaacaaagcttatgattcgtcaaagcataagctaaataaaattcatgagatccgacaacatatgattcggagccaagcccgaacagcttgctctcgattgaatcaagattgtgttgttcactaatctcctctgcgaagatccgatccagtgattcttttagtcttttacgcggtgtcagcctatcactcgggatatccttatagccgtcgggaatccaaatattcgtcaagcaaggtgttcctaattctttcccgaagtattccccgatacggcggcaagcgatgcaatgcctgatccaaaattctctgatatccggatcagggtgtgaaagggtgagtccgtcagccgctttctcatgcgaaaacaaggttggattaaaatctaaaccgagaccaaggttttttgcccatttcacccagttttcaaaatgctgcggcttcaattcgtcacgttctaccgcttccctgtttgtttctgcgtatatcgcatgcaggtttacgcggtgctttccaggaatgagagaaagagccttctccaaatctcttcttaattcttcaggagtttgcgcttttccgggataattgccggtcacgtcaattccgcctgaaagctcgcccttatttacttcaaagccttcaatgtcgtcaccctgccagcagtggatcgaaatgggcacttgctctaattgccgaagcgcctcttcaacatcaattccccatttttcatatgcctgttttgcactgtcataattggcttttatggtcatacggctctctccctttatcagtttttcaatccaaataaaaaacttcctttagatctatcgcaacaggactgaaatccgaatttgttttcattaatggcgccatcgatttccaccatctttggcaaacttccgtgtccgccatctttctccatttctcttcatcctctatttctaaatatgcaaaaagcctgcctgtttcctcgtctagaaaaatggaataatggtgtgctccatgagctttgagtgcttctgccatctctggccaaatgtcatcatgccgctgtttgtattcttcgtacttgtcttgatggacaaacatgatactggcttttcttttcaaaccttttcacctcttcatcatttagatagcgctttcaaaacggtttgctgaaatgactgaatgatggtgcttctgtcaatgtctttaggtgtaaacactttgatcggaaaggaatttctgacgacttgccgggcttcttttatgtctttgacttctttggcagcaatcatttgcatcaaaagatttccgatggcagttgcctctatcggccctgcatataccgcttttccactcatgtctgccgttaattgatttaagaaatcattccgggctccgccgccgatgatatgaaattgctcgatcggttgttctgtgattgtttcgagctctttgatggctatcgcatagatgatggctaaattgctgtagatgcagcaggcaagttcgcctgcagtgcggggaatcttttggcgggtttgtctgcaataatgttgtatttcctttatcatgttttctggattcaggaatcgtttatcatttaagtttataaattgctggaatggttctgtttttttggcttcttctgcaagctgctggaaggagtaatctgcttgtaactgctgtctgacttcttgtatcacccacatgccgataatgtttttgagaaagcgaatggtgttgtttgcgccgcgttcatttgtatagttgttttctaaagcaagatcagttattatcggtgttttgttttcaaccccgattaacgaccatgttccgctgctgatatacgcccagccatcatgtacgcctggcgctgcaatgacggccgaggccgtatcatgtgttgcgactgtcatcaccttgcacgccgggagatcataatccgggaaccactcatttcttagcttcccgagttcacaccccggttcagtcagcggggcaaattgctgttcctgaacggacacggcttcaagcaattcaggatcaagatttcccgttgaggcgtttaaaagctgtgttgtggacgcatttgtgatttccgttacagcttttccggttaaacaatagcctaaataatcaggaatcatcataattttgtctgtctttatcagcagctcacggtcttcttcatacaattgatagatcgtgttgaaaggctgaaattgtattcctgttttttgataaattgcggcttttgagagggtatgttccagtttgtctattgtatgatctgttcttctatcacggtaggagattgcttcccgcaaccgatcgcctttttcgtccagtaagacataatcaactgcccatgtatcaatgcctacggtgcagtgttcatacccaagcgtctttactttttgcagtccttgcaggatttgttttagcaaatgatcaatatcccaaaagcaatgcccgtctctttgactgaaaccgttagcgaacctgtgaatctcttgtatgtcaagcttcccttcattcagttcacctaccatgattctcccgcttgatgcgcctatatcaatggcagtataaatcattctttcaccctctcttcgaaagaggaacagctgtcaccttcacctttttgtcctcaagagcttttaccgatgccggatcaagtccagaatccgtaattaggcggctgacatcttgcagcgaggcgatatgtgaaaactcgcggttcccccatttgcttgaatcggccatcaaaatggtctggtccgacctttcgatcatccgttttttgagcagcgcctgccactcatttgaatcactcatcccgttgtgtacgtcaaatcccttacatgacagaaaggttttattgacatgataggtctcaagtgaacgctctgctaacgggccggcaaacgataatgatttttccagcaaaatgccgcctgttgaaatgactgatatgttttctttattgctgagttcaatagctgctttcattgagtttgtaatcacggtgagctcaatgtcagggagtatttttgccatgtaccaagcggttgtgcttgcatcgagaatgattcggtctccgctttttacatatttggccgcttcgtgagcgatggcttttttttggatgacattcgtgatttcccgttcagaaaaatgaatttctgattccttctgctgaatactgaccgctcctccgtggctccggctcagtttatgttctttttcaagcttttcaagatcacgccgaatggtttcctctgtgactgaaaatatgtcacttaattcggaaacgcggatgcttgaacgcttatttactatttccactattttttgctgccgttctgctactagcatcggtaacgcccttcctcatatcgtagtccgtcttatattttttatcatagcatatttctaacgcgtaaaagcagcagggacgccgccgtctaccgtgatcatgcagcccgttgttttttcggctttggaagaagcgaagaatgcaatggcttcagcaatatcctccgggtaaatattgacgagcaatgctgtccgtttccggtaatgttcctctagctgatctggttcaatcccgtacgccgcggctcgttcctcccgccagcttgaaccccagattgccgatccttgaagaactgcatcaggcaaaacggagttgaccctaatgccgaattctccgccttctgctgcgatgcatcttgctaaatgggtttcaagcgccttaacagagctgtaggcagaggcgttttttcccgcatataccgaatttttcgatccgacaaataccatgcttccgcctctattttgctgtttcatctgtttaaacgcttcacgggctacaaggaaatagcctgttcctaaaacattcatatttagattccattcttttagacttgtttcgtcaaatgggcttgatgtggccagcccggcattattgacggcgatatcaatgccgccgtaagcaagcgccgctcgttcaaaagctgactgtacgtcttcctcctttgtcacatccattttgacagccattgcccgtccttttccgtatgcatcgtttatttccccggcaattttctgtgcgccttccatattcagatcagctacgatcacgtgccctccatcagctgcaaatctgcggcatgccgcactgccgattccgccggctcctccagttatcaacgctacttttcgggaaaattctgcttccggcggggccagcgtgagtttatatagttcgagcggccaatattcgacatggtaggattcattttcatgtaaagaaacaaattgccccagagcggttgctcctttcatcacggcgatggccctccgatataaagccccgcttactttagacatggcataactttttcctgtattcaccattccgattccaggaatcaatatcacccgcggggcggattcaaagatttgatccccatcctgctgattgcgtgtaaagtaagcctggtactctgatgtaaaggtctcgactcctgacttgatcatatctgcaagcttgtgcacatcttgagtttccggattccaatcaatgtatagcggaacccgttttgtgtgaacaaggtgatctgggcatgccgcaccgatttgcgaaagtgctggcgcttggacactgtttacaaattccaagacatcgtcatgatcatcataggaaaggatcattttcttttcttcacttactgctcctctgatcacaggcatgatgcctgccaagatttgttttcttttatcctccggcagcggctgataccttttgcctccgaatacctcatgctgattgatacgatcgttaatatactgctcggcttcttgaatgatggatatcgttttttgataacatgtttcagacgtctctccccaagtgactaagccgtgtttctccattaatataagctcggcgtggggattgtttgctacgccttcagcgatcattttagacaaagtaaatccaggacggacgtatggcacccatacaaaccgatttccgtaaatgtcttcagcgatttgttttccattatccgcacagcatatgctgataatcgcatctggatgggtatggtcaacatgtttgtatggcagaaaagcgtgtaatagcgtttcaattgaagggcggggatgtttgctgtctatcatacaatgagacaggtagtctaccatttcttcatcgggcatttggtcccttttaatcagcgggcggatatcatctaatttcaaaccggaaaagttatgcgctttcattgttgccaaatccgaaccgcttccttttacccacatgacttctatttcacggcctctaaaatccttttccgttgttttcatagatgtattccccccgccccagttgcagacagtgcggtctgacccgatcaaattggacctgtacaccaattcctctacacctttaggcagctgtgcagctcgcactgaatcccatatatgtttcgccatatttgatattcctccatccccttttatttgtatccgttttcattatatatgatttctgtttgtttttgaatcgtttttgtttatttttgctttttaacaaaaaaagaaagcagcagatatgccgctttctcgtttcattatgattctattttaaatttcttcgtaatgtcctgaagttcttccgccatgtttgccaacgtttccgctgaagagctgatttcttccatggacgcaagctgttcttccgccgaagctgcgatatcctgaatgcctgctgagctttctttcgccactgcagaaatatcttcaacagcacttgacacttcctgtgatccggctgacagttgttcaaccgtcgcgttcaagttttgcaattcgccggaaatttgggttgtcatctcatagatttgtttaaagctttctgctgtttgatccgtaatctgcaagccttctttcacttcatgattcacggattggaacattgaaagtgaggtgctgatttccctgacaatctcttgaattaatccttcaatttccttggcggagtctgctgattgtacagcaagttttctaacctcttctgcaactactgagaaacctcttccgtattctcccgctcttgccgcctcaatcgcagcatttaatgcaagcaggttggtttgatcagcaatgccattaatcacattcaagatgcttgtgatgtcttgcgattttgtttcaagacccttcacaactgcttccgctttttgaacggattggtcaattgttttcatctggccgactgtatgctccaccagcttttctccgctgcccgctgcctcagaggactgaatcgatgatttcgtaatggttgaagaggcctgagccacttttgaaatcccctcgttcatttgagaaagatggtttgagcttgtttccagtttctcgctttgtgcctcgttaccatctgagaactgttcgatggcaagtgtaatatgttcagttgccttgctcgtttgggctgcgcttgccgtcagctcctcagaggatgaagcaacgttttctacagacgtttgaataacgccgattacagaacgcaatgatgcagacatttcattaaagctttcaccaagctggccaaactcgtttttcgagtgaatgtcaatgacttctgtgagatctccgctgctgatttttgcagacgttgagacaagttttcttaacggcttggtgatggcacggataatatagagtatgagtatgccgccgattacaattgacacgcatagaatgataaccgcagtgttcagcaccggacttgaagcatcttgcaattcactgacaaaatatgtgcctgcgattttccagccagtcagtttatttgtcgtaaaggccattttcttttctttgccttcgaatgtatattcaaatgagccttcttttttggaatatacttggtttgtccaattgccggaaccggttgtccccggcttaatggtcggatgggcgatatattttttgttgcctgtcgtaataaatgcaaagccttctttaccgattttgattctttgtgatgcagtaagcacttcatccaggtttaaatcaagcgctataacccctgaaccgtcttttaattgttttgaaattgtgataacgatatctcctgtcgcttcatcagtatacggttctgagaaaacagcttgtcctttttccgcaaccgcctgtttgtaccagtcacgtcctgtcggatcgaaacctttcggaacaccgctatccggatatttataaagcttcttatcttctgaagcagcatagattgcgcctacatcgtcgttaagtgtcgtgtactgcttaaatttctctttcagtaatgttttgtttttgcctagcaatatgtctttatcgactgtctcactataataatctattgctttcactttatcttctaatttattttgcagcgtactgtttagttcttcaacatttccctttgcactgcttatgagctctctgtctaacgcgttccaagctgattgataactgaaatatgctaaaaccccaaccggcaaaataagcactgccagaaacgcagcgattagcggtttgctgatcgatggctgtttgatccattgtatgaattttcccattctcgttgactcctcctttaagataaatctaatatcgtcaaactaggataaaaggtttaataaaaaaactaaaaaaaacacccaagcgcaacaagcttgggtgttaaggcttattattcgattttgaatcgtttggtcatatcgcgaagctcttccgccatagaggaaagggtctctgcagacgagctgatttcttccatggaagctagctgctcttcagctgacgccgcgatatcttgtatatgcgctgagctttcttttgaaatcgatgcaatgtgctcagacgctcccgaaacttcttcggagctggcagaaagctgctgaaccgtcgcactcatattttgcagttcgccggcgatttggttcgtcatttcagaaatgcgtttgaagctcatttctgttttatctgtgatgtcaagtcctgtctgcacctcttgattgacagattggaacatgccgagtgatgtattgatttccttcacaatttcgatgattaatccttcaatctcttttgctgaatctgctgactgtactgccagttttcttacttcttccgctacaacggagaagccgcggccgtactcgcctgcgcgcgctgcttcaattgctgcgtttaaggcaagcaggttcgtctggtctgcgatgccgttgatcacacgcaaaatgtttgtaatatctttcgatttcgtttccaatccgcgtacgacttgctccgcttctttaacggacttgtcaatgacattcatttggccgacggtttgatgaacaagcttgccgccttcacttgcaatttctgtcgattgaacagatgaatcagtgatcacttcagaagcttgggccatattcgtcaacccgtcattcatttgataaatgtgctctgctgccgtttcaatgttttcgttttgtttttcattgccgttagaaaattgttcaatcgccaatgtaatgtgctctgttgccttgctcgtttgcgcagctgatgcagtgagctcctcagaggaagcggcaacattatctacggaatcctggatggcgtgtatgagagaacgaagtgacgacgccatattgttaaagcttttgccaagctcgcccaattcatcttttgaacggatatcaatggtttccgtcaaatctccctcgctgatccgcttagaggaaccgacaagctgtttcagcggtgttgtaatcgaccgaatgatcaaagtcatgacgataatccctatgataatagctgcggccaagacaattaaagcaaggtgaaggacaggctgggctgcctcatggatttcatccaaatacatggtgccgccgatcttccatcccgtcaacttgtttgtgtcaaaggccatttttttcttatcgccatccatggtatattgaaaatcgcctttatcagcgttcagcatcttatcgagccagtcgccttttaattcagttcctgatttttcattaggatgagcgacaacttttttgtccttcgtcatgataaatgcgtagccttgtgtgccgatgttgacttttttggttgttttcaacagattttcaatcgtcatgttgattgcgataacgcctgaaccatcttttgtctgctgggcgattgtcacaaccatcgtatttgtagaagcagttttataaggatctgtcacaacgacttttcctttatttgcaaccgcttttttgtaccagtcgcgttcaaccggattatagccgcttggcatcggaagatccggatagcgggtaaagtgcccttttgtgtcacttgtataaatggattctacatccttgttaatgctgatatattgtgagaatttctctgcaatgcttgcattgctttttgcattgtatttctcttttgtcagccattcgctgaaataatcagcactgttttctttttcgccgatgctggtgttaatgatttcgtttaattgctgtacattttccaatgcgctccccatcatctgtctgtcgagtgagctgctagccgattgataggcaaagatcgccaatataacaaccggtatgatgaggatcgacagaaaggaaacgagaagcttccgtgtaattgatctttgttttatgagttggagtatttttttcatcattcatttctccttttttatgctacccttcatatcggctggaaatgggtaaatatatacagcaaaaaagaagaaatttaacgaaagtaactaatttcccataaataaatagtatattagacctattatctatccactttaaattgttttgtcagatcacggagttcttcagacattctttcaagcgtcagtgcagatgaactaatctcctccatggatgccagctgttcctcagctgaagcggcgatatcttggatgccatccgagctttccttagaaatggctgtgatatcatttgaagctgcggaaatttcttgagctcccgctgacagctcctcaaccgtcgcattcatgttttgcagctcggaagcaatttgattggtcatttgcgatatatgtttgaagctctgtttagtttcatccgtcatgacaagccctgtttcaacttctttgtttacggactgaagcacgttcagtgatgtgtgaatttcttttactatttcactgatcagcgattcaatttcttttgccgagtcagccgactgtaccgcgagctttctcacttcctcagcgacgactgagaagccccgtccgtattcacccgctctggccgcttcaatggcggcatttaaagccaaaagattggtttgatccgcaatgccgttgatgacacgcaaaatattcgtgatatcctttgatttgatctccagccctttcaccacttgttccgctgcttttacagaatggtcaattgtgttcatttggccggctgttttctggacgagtgtctcccctttacttgacacttctgttgaatctgcggatgtttctgtaatcactgctgcagcccgcgccagctctgccaatccgtcattcatttcattaatttgttcggttgtcgttactattttctcgctttggctttcactgccgtttgaaaattgctcgatagccatcgtaatgtgctcagtggctctgcttgtctggtctgccgatgcagtcagctcttcagacgatgaggcaacgtgctctactgagtctttgatcccgtgaatgagcgagcgaagcgagtgtgccatatgattgaagctctcgctcagaacaccgagttcatcttttgaattgatttcaatcgtttcggttagatcgccttcactaattttttcagcggatgcgacaatacgtctcaatggctttgtgatggatcgaatcacaaaataaatcgccgtcattccagctgcgatggcaatcgccagaacgattgaagccatgatcagaaccctgcttgcagcatcgtgaatctcgtttgcatacatcgtgccgctgattttccagcctgttgtttcgcttgttgcaaatgccatttttttctttttgcctttgtacgtatattcaaagtccccgcttttatccttgtagagcttatcaacccagtccccttttagctctgttcccgctttttctccggagtaggcgatgactttcttgttttggctcaagataaaagcatagccttcttttccgatattgattcctttcgcggtagtgactaagtcatcaattttcatatcaatggcgacaacgcctgatccatccaccgtttgacgggcgatggtgacgaccatttttcctgatgaaatcgattcataaggctcagtgacaattgttttgcctttattggccattgcttctttgtaccaatctcgttccaaagcattaaagtcacttggcatgtcagcgtacggataacgtgtgaattccccgtctttgccgcttgaaaataccgcagcgacattatcattcatttggataaattgtttaaattcctgtttcagctctgttttctttttatcctgaaatttttctgctgtagcccaatcgctgaaatacgcgaggcttttttcagtcgtactgattttatcatcaatgatgtgatctaatatctgaacattttcctttgcgctttgcgtcatctgtacatcaagtgaggcaactgctgattgataagcgctaaccgaaagggcggttatcggaacaattaagatcagcaggaaagaaataataagtctccttgcaattgatgatctgcgaatagtggtgagtgtttttttcatttccttttgaaccttctttcaataatttacaaattatatcggcggatcttcctttaaattacattgaaaatgaaggtaaaaatgaaaaatagttctaaattcaccggttaaactaggactttattattgtttaccatataaaaaacagcgctttgatagcgctgtttttcggtttttactcgattttaaattgtttcgtcagatcacgaagctcttctgccatctgcgcaagagtggtcgctgaggaactgatttcttccatggaagcaagctgttcttcagctgatgcggcaatgtcctggatgctagccgagctttctttcgacacgtctgcaatgccgctgactgctgctgaaacatgctgtgaacggtctgacagctgctcgacggtggaattcatcgtctgcagcttgcccgcgatttcgtttgtcatgctgaaaatgctctggaagctttcttttgtattgtctgtgacaacaagtccggactgtacttcctgattgacctctttaaacatgtgaagagaggtttcgatttctgcgacgatttcttggatcagcttttcgatttcttttgctgaatcggctgattggacagccagcttgcgcacttcctccgctacgacagagaagccgcgtcctgactctccggcacgcgccgcttcaatggctgcgtttagtgcaagcagatttgtttggtcagcgattccgttgatgactctcaaaatgcttgtgatgtcttttgattttccttctaagcctttgacaacagcttcagcctgctgaacagattgattaatcgagttcatttgtccgactgtctgctgcacaaacttctcacccgttccggcgatttccgttgattggatagatgcctttgtaatatctgacgatgtttgtgagacttgctggagtccttcattcattaagttcagctgatgagagctggattcaaccttttcgctttgctcctcgtttccgtttgagaactgctcaatcgccatcgtaatatgctcggtggctttactcgtctgcccggcagatgccgtaagctgttcggaagatgcggccacattgttcaccgagtcctgaatagcgctgatcagagagcggagagattgtcccatttcattgaagctttccccaagctccccaagctcattctttgaatggatttcgatcgtttcggtcagatcccccctgctgatcgttttcgatgattgaacaagacgttttaacggttttgtaatcgaacgaacgataaacagaattaaaattccgcctgccacaatggaagcaatcagcacgatcattcctgttgtcagcacagactttgaggcatccttaatttcatccatatacattgtgccggctattttccaaccagtcagttcgtttgtagtataggtcatctttttatcttcgttattaagagtatactggagttcaccgctgtcattcgcatacattttggctacccagtcgcctgaaagcttttctccagccttatggttcttgtgggcgacataggttttgttttttgttgcaatgaaagcataaccttcttttccgaccttgatttgtttcatttgttctaacaatttatcaatggtaatatccatggcgacaacgccagatccgtccttcagctcctgtgcaatggtaatgaccatgcttccgtcactcgcagccacgtaaggatctgtcacgacaatttcaccgccggccttcatcgcatcctggtaccaagggcgttgtctcgggtcgtatccgtccggcaatttctcttttggcgcttgtacgtaaatgccgttatctgcacccccataaattctggctactccttgattaatagatacatattgtgaaaatttagctttgatctcttcttgatttgatttccctttgaatgcggatcttttaagagattcactgaaaaaggtgactgctttcgctttttctcccagattatttgtaacagttgtattaaatgtatcgacactgtttttcgcatttcccataatttcctgatccagctttccgctggcgcttcggtaagagctaaattctaatataagaatagggataatgagaatcgcgataaatgagacgattaatttctttgaaatagacggtttcttcagccaattgataaaagtcttcatgtcacttgctccttcaggtttgatacagtatatatcggctgcttaaaaaagttttaaaataaaaaatggaagaagttctttttggctgtcttctgtctttttaactttcattgcccaagccctttgcatatcttataaaaaacaaggggggctaaacatgattattgtatcaggacaattgctccgtccccaggatattgaaaattggcagattgatcaaaatctgaatccgctgttaaaagagatgattgagacgcctgttcagtttgattatcattcaattgctgaactgatgtttgagcttaaactgcggatgaatattgtagcagcggcaaagacgctgcacaaaagcggggcgaagtttgccacttttttaaaaacatacgggaatacaacgtattggagggtttcaccggagggcgccttggagctgaaatacagaatgccgccttcaaaagcgattcgggacattgcagagaacggcccgttttatgcgtttgaatgcgcaaccgcaatcgttatcatttattacttggccttaatcgatacaatcggtgaagataaattcaatgccagctttgacagaattattttatatgactggcattatgagaaattgccgatctatacggaaacaggacaccactttttccttggagattgtttgtattttaagaatcctgaatttgatccgcaaaaggcgcaatggagaggcgaaaatgtgattttactgggggaagataaatattttgcccatggtcttggaatcttaaacggaaagcaaattattgataagctgaattcttttaggaaaaaaggagccttacagtcagcctaccttctgtcacaggcgaccagactggatgttccgtctcttttccgcatcgtccgctaaaaagccccatcgcctattttcgggacgatggggtttcaaatgtctttcgttttcgatagaagggggctgtgccaagatattggttcgcagcccactccattttttcaaggtcatttcttgttacgattggatccaggctgctccatttgataaagcggacaaaatagtagcctttgataggagccattgtaacttttgagtgaggccagccttcaaatacaaactcaattttccctctttttttataagaatattgaagaatgttcatatctgtcacctcagtttatcaagttacgttcggcaaagctcggtacgtttacatccattgattgactatccctcatgcaggctttcctgaaaacaaaggatgaggcgcgtgtctctttcccgcgctttttatttcgcatatggacgaatgccaagcgcgccttcattcgataaagccgcagcgtgggcgggtgtgacaggccctccggctatcggcgcttgttcagcgatcatgcttttgtcataaaaaacagcctattatcccatcattttgatatagcatgtccgggtgcgagggccgtcaaattcgcagaaataaatgccctgccacgttccaagaatgagccggccgttttccacaatgacatgctgtgaagctccgactgtactcgacttcatgtgtgcagctgtattgccctccatatggcggtccagctcatgttcccacggatatacctcatcaaaccttctgagcatatcttttttgacgtccggatcggcattttcattaattgtaatgcccgcagtcgtatgcggacagtaaatcagcgctgcgccgctcgttatacctgtttcttgaagaaacgcttccacctcccgggtgatatcaatcatttcatctcgtttggttgttttgatttgcagtgttttcagcatttgtttctcctttcgtttgtccgctctcatcgcttaattcgttctgtgttcttttttttcctgttaaaccgctctcataaacccgttaaaacaaaaaaactccagtctaaggctggagtttagcaccatagatatattcttgcttcatacggctttaagagtactgatgtcatatgctggtgcggctctgcttcaatatttgacaagacgagtgcatctgatgacaatggcaatccagagtgcttgaacaacgccggtgttcctgtcagattggccgcaatcagtgcagtatggctctcatttttccgaagatatgcaaagatttgctgatcttccggtaaaatgagctcgtatgtcccgttaataaaaacatcatatgtttggcgcagcttgatcaagcttttgtaaaaatggtaaacggatgttttatcgtttttttgcgcctcggcattcagccatttgtaattctcattgattccgatccacggtttggcctcagaaaatccggcgtatggaccagcattccattgcatcggcgttcgcgaattgtctcttccctttttccagacaatcttcatcacatcctcgtgtgatgtgcctttcgctgtttttgtttcatacaggcgtttcattgcgacatcatcatagtcctcaatagagggaaaagccacgttcgtcatcccgagttcctgtccctgataaataaacggtgtgcctttcatgagaaaataaacagcggaaagcgcttttgcactttctttcaggtacactccgtcgtctccccacacagaaactgaacggggctggtcgtgattctccataaacaaagcattccagccgatcccttccagactgtcctgccagtcagttaaaattcgtttaaatgcaacgatatcaatactttcattgatctctacatcccacaggccgagatgctcaaattgaaaaatcatgctgaatatgccgtttttttctccagcccaatcagctgcttcttttgcagcgacgccgtttgcttcaccaactgtcataatcggatagcgggaaaatgtgttttccttcagatctgttaaaaaatccataataccgtcagcattcatatgataaggaaaggaagggacatagtccagcccctttggattcggcatgtcgggaagcccttcttttttcttaatatgcgtaatggcatccacccgaaatccgtcaattcctttatcaagccaccaattgatcatgtcataaacggcattcctcacctgttcattttcccaattcaaatcaggctgttttttatcaaaaaggtgcagataatactggcttgtcttttgatcatactcccaagccggcccgccgaaaatgctttcccaattgttgggcgcttttccgtttttgccgtctttccaaatataccagtcgcgcttttccgagtgtatggatgaacgggattctatgaaccatggatgttcgtcgcttgtgtggttcacaacgagatccataatcagcttcatccccagatcatgaatgtcaccaagcagctcgtcaaaatcttccatcgtaccaaactcgcttaatatgttttgataatcccggatatcatagccattatcagcattcggtgagtcatacagcgggcaaatccatatgacgtcagcgcccagctcttttatgtaagaaagcttggatctgattccttgaatatccccgattccgtcgccatttgaatctttaaaactgcgggggtaaatttggtaaacaacggcttccttccaccaagcctttttcatacagccactccttcccagtgtaccgttcttatatatcctatgtagaaaaaggtctttacagcattgctttttaagaaatgacttgatgacacaaaaaacagccgtttgttccccggctgttttttatcaaaaatcagtttttttaatttctacaaaacggatgtgatgatcttcggcgtcgaggattttaaattcacagccctccgcgtgtatcacatctcctgctttcagctccattttttgcgttagaagccagcctgcaatcgtatcaatttcttcattttcaatcgcaatgtcgagaaggtcattcacttcgtctattagcgcttttccatccatcacataatggtgctcgccctttttcaggatgtgcggtgtttcatcctgatcatactcatcgcggatttccccgacgatttcctctataatatcctctacagtgacaagccccgccgttcccccgtattcatcgacgagaatcgccatgtgaatccgctccttctgcatgcggattaaaagctgttgaacaggaatgctttcaatgactctgataacgggcctcatgatttgctccagctttatcggctggccgagaaaataagctttaaacatatctttgctgttgatgatccctaaaatatgatccttgtcatctttgatgacagggtagcgtgtataccgttcattaatgatgtgatgaattgcctcttcaagcgactgctccagagagataaccgcaatttctgtccgcggaatcataatctctctcgctacccggttgtcaaattcaaaaatcttatttacatagcggaattcagactgattgatttctcccttttcatagctttctgaaaggatcagtcttagttcctcctcgctgatgacaacctcatgctcctttactgaatgaaagccaaacaatttcacaagaaagcttgcagagccgtttaatgccttaataaacgggtacgtgattttataaaaccagatcagcggctttgcaatccataagcttacagcttcagctttttgaatagaaaccgttttcggggcaagctcccccatcaccacatgcaaaaaagtgacgatgataaatgcaactacaaatgtgacaatgtggttaaacggttccggcatgcctgtcattgtaaataagggatgaagaaaacgttcaaatgtaggttcaccaagccacccaaggccgagggctgtaatcgtaatcccgagctggcaggctgataaatactcgtcaagattggagatgattttatgtgcggctagtgctcggctgtcaccgctttcgatgagctgattgatttttgaacctctaattttgacgatcgcaaattccgctgcaacgaaaacagccgtaatgccaatcaaaacaaaaatggcgatcaattgtaaaataagcaaaaaaagcccttaccataaatggtaaggggccacctccttaacgttaattctcatcacgaccgtttaagaaaatcatcacaaaacgaagtagttcaaacagggaaaccagggcggcggccacatacgttaaggcagcagcactcagcactttatttaccccattttcttcattgtttcggatgaatccttctgacacaataatctgcttcgcacgtgaacttgcattgaattcgacaggcaatgtaatcagctggaaaaagactgccgctgaaaacagtatgatgccaagcccgatcaaattcaggctgccgagaagcatgcctcctaagaaaagcaaaggagctacaccggatgcaaaattcacgactgggaagattttatgtctcagcacaagcgcaccatatgactcctgatgctgcaaggcatgtccgacttcatgggaagctacggatatggcggaaattgagcggccgtaatagaccggctcagataaacgcaccacccgtcttgtcgggtcgtaatggtctgttaaagtgcctcttaccggttcgaccggcacgtcgtaaagaccgtttatatctaaaatccgtcttgccgtttctgcccctgtacgtccgcttgaggcttccacttttgaatatttttcaaagttgctctttactttaaattgtgcccaaaacgacaatcccaatgcggctattgttaaaaatataaacagcattttttcatcatcctttttccatgatcatttctctattacgattattttaatgagttttctttcccgtgtacagaaatgcgctttttcttccggcttggagcacagaatccaatcagcaaaaagaacaggcctgctgaaaacaaataaaaggcgaaactgccggccagttctttcagaaaataaaaccaggagaagctgccggaaaagtgattatatgaattcaaatcgaaaataaacaaaatcaccgcggatgccgccagctgtgtaccgatcaaaaccacgatcgttctttgaaagatcgtcatctttttcatcctttttgttttagtttatggagaaatccggttttatatgttttgtacattttttgaaaaacatcaccggaagtgggacatactgttagaaaaaagcacgggtgtgatggaagctatgaaagtgacgagtgaggaaaaggaacagctgagcacagcaatcgaccgaatgaatgaaggactggacgcgtttatccagctttataatgaatcggaaattgatgaaccgcttattcagcttgatgatgatacagccgagttaatgaagcaggcccgagataagtacggccaggaaaagctaaatgagaaattaaatacaattattaaacagattttatccatctcagtatctgaagaaggagaaaaagaatgaaatcaaatcggatatttatttcatggctcaggtggccgttatttatccgaatcggggttattattttatgtctgattcttttgttcggccaaatcatttatattcttgagcctaagcagttcacttcggtattcgaaggcatttggtgggctgtcgttacagtttcgacagtcggttatggagactatgtgccgcacacgccgctgggacaggcagccggaatactgctgattttgagcggagcaagctttgtcacagcatatttcgctacgttatcagcggccgcattcagcagacagcatcgctacatcgaaggaaaagttgcttacaaaggccgggaccacatcattctgatcgggtggaatgaaaaaacaaaccggcttttgaaggaccttcagcttgccgccccttccaaaacagtcgtactaatcgatgaatccttaacagaaggcccgcttattgaaaacgttcatttcatacgcgggcacgctgccgatgatgggacactgaaacgggccaatattactgaagcggaatcagtgatgattactgccgatcagtataaaagtgaaactgatgctgatatgctgtcagtgctgactcttttatctgttaaagggcttaatccccttgcttactgcatcgtcgaaattttgactgaccgttttgtcaccaatgcagagcgggcaggcgcaaaccaaatcatcggaacttcagaatttatcagccgggcgatgctgcagcattaccaagtcaagttacggccgcctaaacagcagaacggaatcaagctgacacttgatcagcatgtggagcttcttgctgttcctgacgaactaaagggagcggcttacaaaacctgtgttctctatttccttgatcacaacacaacaattataggcgtacaaaaaaaggaggggccgatgctttcccctcctcttacatacaaggtgctcgaaacagatcaattccttgccatctagtgtaacagaacatcctccaattctttcacgagagaggcgccgatatccaaaaatgccggatcaatttccgcgtcccgcctttccggttcggaaaattgattaaacagtgattggaaaggccctccctcggcgtgatcgtcaacatccgcctgaaacacctgtctcagcataaacggcgttccgatccggacggccgcccctcgttcatcgagactgccctgtaccgcattgacgggaattcttaaaaataaatagccgtctctatcatcaattttataatcaaagtagccatgatcgtattcccagccgccgtttatcacataaccgagcggcttcatcacttgttccagttcttgaagcagaaaagactgcccatctatcgcggaaggtattggtatcatcagaatgccccttttttcacttatcctgtcccgccgaacaagacttcattcagaggcgcctacatggaaatcgttgtttctttcgcgcggccaacagaaaagaaagcgcattcaattaagaagtaaacagtcattgccgctgcaagccatacagctgaatcccaagacacataaacaaccgttgcatagagtcctaatttagtgaaaagagtatgggttcgttttaaatgcaaaatccgatgtaccgcatcggtaaaaagggcaagcggcaaaccaatgagaagaaaggcgtggatgaaaaaatgtgacagcgtgccgccaaagcttgaagaaaactctgtatacacggcatcaaaggagataaggaaacttaaaatagctgcagaaaaaccggcaatgatgagatgtttaaccaattgtttcatgaacatcagcacctttctgattttataaaaagccgaccggcaaatgccagtcagctttctcacattaatcttccagacgtttttcaagctctgcttttttctcttcaaagccaggtttgccgagtaacgcaaacatattgactttatacgcttctacaccaggctggtcaaacggattgacgccaaggaggtaaccgctcatcgcgcaggctttttcgaagaaatatacaaggtatccaaaagtatatgcattcagctcaggaatgttaacgattaagttcggaacatttccgtctgtatgggcaagcattgtaccttggaatgcttttttgttaacgaaatcaacagttttaccggctaaatagttcaagccgtcaagatcgttatccgcttcctcaattgtcagttcatgtttaggtttctctacgttcaggaccgtttcgaataaatctctgcggccttcttgtacatactggcctaaagaatgaaggtctgttgaatagttcgctgaagaaggataaatgcccttctcatctttcccttcgctttctccgaacagctgcttccaccattccgcaaagtattgaagcgccggttcgtagttgatgagcatttcaattgttttgcccttattataaaggacattgcgaacaaccgcatattggtatgctgggttatcttccagttcagatgttgcaaaatctttgctcgcatccagggcgcctttcatcatgtcatcaatgttgacgccgctgacagcaatcggcaagagacctacagctgttaaaactgaataacggccgccgacatcgtcaggaataacaaatgattcgaagccttcttcgttagaaagcgtttttaatgcgccgcgctctttatcagttgttgcataaatccgcgctttcgcttcttctttaccgtatttctcttcaagaagcttgcggaaaatacggaaagcgattgcaggttcagttgtcgtacctgatttagaaatcacattaatagagaagtcaacatcttcaagaagatccatgacgtctctcatataagatgaactgatgttgttcccgataaaaatgacttgcggattgccgcgttttgcttttggcaaagtgttataaaacgcgtgattcagcgcttcaatcgctgcccgcgctccaagataagaaccgccgatgccgacaacaagcaagacatcagagtcagatttgattttttccgcgctttttttgatgcgcgcgaattcttctttatcataatgttcagggaggtccacccagcctagaaaatcgctgcccgcgcctgttttttcatggatattatggtgtgctgtttttacaaagtcccgcaggtatgtaagttcatgttcgttgaagaaagtcaacgcttttgagtagtcaaagcgtacatgcgtcattgcttgtccctccataacggtataatgttttcatctttcactttatatgaacttatctgtgaaatcaagtcaagaagaaagggcggaatgactggattccgccctttgagtttatagagacgcgcgaaggatggcaagcacgtcatctttgttcaatttttggaagttgccgaagccgccgtgttccatttccttggctgcgatatcagcaatcagctcaagcttttcttctccaatattgtaatcagcaagacgggaaggtgcaccgaggcttgtccagaacgcagacagtttatcgattccttcaagcgcaatttctttatctgttttgccttcagtatcaatgtcaaacatgttgagcatgaggtttttgaagcggcctacatttgtatcaagagtatatctcatccagttcgggaacagtatcgccaaaccgcccgcgtgcggaatatcatacacagctgaaacggcgtgttccattgtatgagaagcccagtcaccaaagtagcccatttggagcgtgccgtttaaagcgattgtaccagcatacaaaatcgtttcacgaagctcgtagttttccagatcttcaagaagcttaggagctgtttcgatgaccgtctgcaaaacagcaaagcacattctatcctgaagcggcgtattttcaacattatggaagtattgttcgaatacgtggctcatcatgtcaaccatgccgtatactgtttgattttccggaaccgtgaacgtattttcagggtctaaaatagagaaacgcggatgagtgacattgctgccccatacaaatttctcgtttgtttcccagtttgtaatcacggaatcagggttcatttcagagcctgttgcagcaagcgttaaaacagtgccaaacggcagcgcatcctccgctgttacttttttgctgaaaatatcccaagcgtcgccatcgtatttgacgccagctgcgattgcctttgtacagtcaatcacactgcctccgccgacagcaagcagaaaatcaatgtcatgctctctgcaaaggcctatgcctttttccactgttgcaagacgcgggttcggctctacacctgacagctcatgaacaacagcgccctcttcttttaaaatgcctgtgacttgatcataaaggccgttgcgtttaatgctgccgcccccgtaaacaagcagtacatttttgccgtatcgtttgaattcttttcttaattgttcaagctgaccttttccaaaaatcagctttgtcggattataataagtgaaattttccatagtaaaacctccaaatgatgctggtgaaaaacagattttccattgtaacataagttgacaaaaagaaaaagggaagcagccaaacggctatttccccttttttatagtgatgctttcaaaattgacagcacatcttctttgttgagtgatttaaattggccgaatgtaccgttagccattgccttgtcagcaattgtgtcaagctgctcatcattaatatcataatcagcaagacggttcggagcgccaaggcttgtccagaatgcggacagcttatcgataccttcaagtgcgatttcttcatctgttttacctgcttcttcaacatcaaacacgcgaactgcaagctgtttcatgcgggcagggttttcagacaatgtgtgtctcatccagttcgggaacaaaattgccagtccgccggcatgcggaatatcataaacggctgatactgcatgttcaatattatgagtagcccaatcccctcttgcacccatagaaagcatgccgtttaatgcaattgttcctgtgtacaggatcgtctcacgcaattcgtaattttcgagatcattaatcagcttaggtgctgtttcaatgactgtacgcagaagtgattcacacatgcggtcctgatacggcgtgtttgatacatgatggaagtattgttcgaatacgtggctcatcatgtcaaccatcccgtagatcgtgtggtttttaggtacggtaaatgtattcaccggatcaagaatcgagaatttagggaatacgagcgggctgccccagccgtatttttcttttgtttcccagtttgtaataacagatcctgagttcatttctgaaccagtcgcagcgagagtcaataccgttccgaatggcaaagcatcttttggctgatgctttttcgtaacgatatcccacgcatcaccatcatacttcgctcctgcggcaatcgcttttgtacagtcgattacgcttccgcctccgacagccagcaagaaatcaatgttttgttctttacagatggcaacacctctattaacagttgacacacgaggattcggttccacacctgctaattcatgcacggtcgctccggctttattcagctgttcaatcacttgatcatacaggccgctgcgtttaatgctgccgcctccgtacacaagcaatacgttttttccgtaaggtttgagttcctccggaagtctttccacttcgccgcgcccgaaaattaatttggtcggattccagtatgtaaagttttgcatgacatctcctccttagattttttattatgcagaatgtcctcaccacatgtaaagcaatcagctctcaccggtcagcataccagatggttttattttgcaagatgctgggaaagaagctgatataagcgagggcaggccagcttccctcatatggagaatgcatgtatagattctccaatatgtcacaatctataactgttttaataattcatggaggaggttgcaaaacatgagtaccattcaaagaatttgtcttgtattaaccatcattggcgccattaactggggactgatcggatttttccaatttgacttagtagcggctatcttcggcggccaagggtcagctctttcccgaatcatttacggacttgtcggaatcgccggcttaatcaacctcggtctgctatttaagccaaacgaggaaagatcacgtgaagaagcagcaaatcctgaaatgcgataggatatcaatcacgctgaaataggattttgtattaaatcaaaagcaccgaacattcctgtccggtgctttttttcatgcttattttttgataaggtctttgcggttggacatttcgatccactcttcaagcttatcttttaatgtgttgaaaccttgtggtgtagaagcttcttcgcttacttgagcagctttaggttttcttggtttgctttcttttttctcaggcgcagcttgtgtcgcacgaattgaaaggctgattttgcctttttcttcatcaacagcaagtacttttacttgtacttcgtcgccaactgaaaggtgctcgttgatatcttttacgaaaccgtgagtcacttcagaaatgtgtactaaaccttgagtttcttcatctaatgcaacaaacgcaccatacgcttgtaatcctgtaactttaccagtgtaaacactgcccacttcaaattttgctgccattcataacaactcctaagttaaattaaatatctgtttatacgcaatttaaaattatatcacacatgtcttatttccgcaaagaaaactttttataaaaaatcaggtttatgcacagcaaaaagggggtaaactgaaaataccaaaggctttctagtattccccccttttattggatgcgaacaaaaggttcgtatctttttttatgttgttttttgcaggaagcgtttcattctgactaacgcttcttgaagctgttcaatcgaggttgcgtatgaacaacggatatatccctcaccgctcggaccaaacacacttccaggaacaactgccactttttcctgcgtaagaagctcctcggcaaactgttctgaactcattcccgtgcttttaatagatggaaaagcatagaaagcgccgcccggatgatgacagctgaggccgatttcattgagcgattctacaaacagattccgtcttcttcgatagctttttttcattttttctacgtcttccatgccgttcttcaggccttcaagggcggcaaactgcgccattgcgggcgcacacatcatcgcatattgatgaattttaagcatggcatcccgaagcaaggatggtgccgcggcaaaaccgagcctccagcccgtcattgcaaatgcttttgaaaagcctgagatgactaccgtccgttccttcattcccggtaatgccgctatacttgtaaattcctcatcatatgtcagctccgcgtagatctcgtcggctaaaacgatgacatcatgttttttggcaaacttagcaatctcattcagctcttccttcgaataaaccgaacctgtcggattcgatggtgagcagatgagaatggcctttgttttttcagtgactgccgcttcaaaatcagcagccgttgctttaaatcctttgtctgccgttgtatgaacgtgaaccgggataccgcctgccaaagaaacaagcgcatcgtaagccacaaaacacggctcagggatgatgacttcctcacctggattcacaatggcgcggatcgcaatatctaaagcctgacttgcccccactgtcacaatcagctcattatctggcgagtagctaaggtcaaacctgttgctcaaataacggctgatttcctcccgcaatgagtataaacccgcattggccgtgtatgacgtatatccttgttcaagagagagaatgcttgcttcgcggacattccacgcggtaacaaaatcaggctcgccgacgcctaaagaaatgacgccttccatcgttgccgccaaatcaaagaatttgcggatgccggatggttttatttgttgtacatagtctgataaatacgaagtcatttacggtgacaccacgattcttttgtcgtcgtctcctgtttcaaacactttgccgtcatgcttgtattttttcaggataaaatgggttgtcgtagatacaactgaatcaagcgttgagagtttatccgaaacaaaacgcgctacgtcagacatcgaattgccgcgaatcacgacagacaaatcgtatacgcctgacatcaggtaaactgattcaacctcttggaatcggtaaatccgttccgccacttcatcaaaaccgacgccccgcttcggcgttactttgacgtcgatcatggccgtaacgccctcatgtccgtctacttttcgccaatcaatcatagcggaataatcgataataaccttttctttctccagtttgtcaataattgtttttacttcatttacagggatgcccgccatctttgcgattgtttctaaatcggcgcggctgttttcgtctaaaatttctaatatttctgtttctttttctgtcaatttcatttgattcacacctttgcaatgtcaagaaatctcatgacattatatcacgttttttgacgaatgctaagaaaaaacgaggagaaacttccgctagaatttacaatttcagggcataatacaaccatcaaaaaaagggagtgacacagaatggaggcggtttcaccaataaggcggtttatggtcgatggagtcaatgtatactacgaacattatcaaaatcccggcaggcaaacgctggtctgcgtacacggttttttatcatctgcattcagcttcagaaaagtaattcctctccttcgggacaagtacgacatcatcgcgcttgatttgcctcctttcggccaatctgaaaaatcaagaacgtttatctatacctatcaaaaccttgctaagcttgtcattgggattttggagcacttgcaagtgaaacaggctgtgcttgtcgggcattctatgggcgggcagatatcgctgtctgctgctctccaaaaacctgagcttttttcaaaggttgtgctgctttgcagttcagggtatttaaaacgttcacacccgacgatcattttcgggacccatatcccgtattttcatctttacatcaaacgctggctctcgaaagaaggcgtgatgaaaaatttattaaatgtggtgcatgacaaatcgctgattgatgaggagatgatcgacggctatggcagaccgtttcaggacgagcagattttcaaagccatgacaaggtttatccgccacagagaaggagatttagaacccgagcaattgaagaaaatgaacaagcctgctctattgatttggggcgaggaggatcgaattgtcccaatggagatcggtaaacggctgcacgcagatttgcctaattccgtgctgtactcacttggccagaccggacatctggtgcctgaagaacggcctgaacttgtttctgaacacattgctgattttatcaattaaaaaaaccggtgctgaaccggtttttttaaggcgtgcaggagctgctgtttttaatgaataaaagctggccagccacttcccggcagctggcgatcggcagcgtttgttcaaaagaagtttcaaatatttgctgaatgcttttcgccagcacgtcgggatcgtcttcatcatagactgcctgcacgacatcaacagcctccgtttcgtaaaactcttctccatatttaaacgggtcccacttggcaatgatcttaatcatttccctgaccgcttgactttcttccatattcatcaccgcttataataaaatttgcagttctatcttatcatagtgaagcttagaagaataaacatacatgagggggtaacagaatgaactttgataaacgagaagaacgccttggcacccaatcggtcaaatgggacaaaacaggcgaattatttggcgtgacagacgcactcccgatgtgggtggcggatatggattttcgcgcgccagaagcgataactgaagcgttaaaagagcgtcttgaccacggtatttttggttatacaactccagatcaaaaaacgagggatgctgtgtgcggatggatgcaaaacaggcacggctggaaggtgaatccggaaagcatcacattcagccccggcgttgtaacggctttgagcatggcggtacaagcttttacggagccgggcgatcaagtagttgttcagcctccagtttatacgcctttttaccatatggtggagaaaaacggccggcacattttacataatccgctgctagaaaaagacggcgcatatgcaatggattttgaagatttggagacgaagcttagtgacccaagtgttacattgtttattttatgcaatcctcataacccttctgggcgttcatggggccgggaagacttactgaagctaggcgaattgtgccttgagcatggcgtcacagttgtatcggatgaaatccattctgatttaatgctgtacggacacatacacacgccgttcgcttcgctctctgacgatttcgctgatatttctgtgacatgtgctgctccaagcaaaacatttaatatcgccggattgcaggcttcagcaatcattattccggatcgcctgaagcgcgccaagttttccgcaagccttcagcgcaatggtttaggcggactgaacgcgtttgccgtcactgcaatcgaagccgcgtattcaaaagggggaccgtggcttgatgaattgatcacttacattgagaaaaacatgaacgaagcggaagcctttttgagcaatgagctgccaaaggtcaaaatgatgaagccggatgcatcatacttgatttggctcgacttcagcgcttacggcttgtccgatacagagcttcagcaaagaatgctgaaaaaaggaaaagttattttagagcccgggacgaaatacgggcctggcggagaaggatttatgcgcctgaacgcgggatgctctcttacaaccctgcaggacggcctgcgccgcatcaaagccgcattatcgtaaatatagctgtaaacgcctttacgtcttcatttgtaaaggcgttcttaataaaggaattttatattttacttctaatatttagtgttataatagattcatattttatacgaaaggatttcacacgaatggaaattctaaaagactatcttctgcatatctgctttattttgtttcctattcttctttaccaagtgttttggcttggaaaacctgcgattcttgtgccaaaaataaacagcggtttggtcacgctcttcgcctgcggcgcctccgttttatgcattattttcccgattcatgaaatggactacatacaatacggccttcagatgattcccgttatcatttgtttattttacattagtaccgcttccggacttacagtcgccgcatctgtcctatgttttgaactgcttttttacgaaccttccgcaatgtttgttttcactttgctgccttttcttatcattatcccaatcttatttcagaaaaaatggccattcatgtccaaagcgaaaaaactgctgctgtctttattgatcagctgcgtggagattttcctatttttcgcctcaagctggattctttccgccttgaatattttaaattttcaaaaatcaggaattttcgtttacgaggcggcagtctcagggcttttccgctccagtgttcttctattaagcatctatattatcgaaagcatcgccgaaaatatcgccctgcgttcacagcttatccattctgaaaaaatgacgattgtgagtgaactggcagcgagcgtcgcccatgaggtcaggaatccgctgacagttgtccgcgggtttgtccagctgctttttaatgacgaaaccttacaaaacaagtcgagtgcggattacaaaaagcttgtactgtcagagcttgaccgggcgcaaggcattattacaaactatctcgatatggccaaacagcaattatacgaaaaagaggtttttgacctatctgcccttatcaaagagacaagctcccttatggtgtcgtacgccaattacaagtcagtaaccgtcgaggctgaaacagaaccggaccttttgatatacggagacgcaacaaagctgaagcaggctgtcatcaacctgatgaaaaacagtattgaagcggttcctcacgggaaggggatgatccacatatcagccaaaagaaacggccatacgatcatgattaacatcacagacaatggggtcgggatgacagaccatcaaatgcaaaaactcggcgaaccttattattccttaaaaacgaacggaacgggactcggcctcaccgtaaccttttccattattgaacatcatcacgggaccatttcatttaacagcagcttccaaaaaggcactacggtgaccattaagcttcccgctgatcttcctcactagcaaatcgattggaactttaatagaataaatgcgaggtgatgacagatgagcacgtttgaaacaggctctatcgttaaaggattttacaaaacaggtgtatacataggagaaatcacggcttgcaggccgcagcactatttagtgaaagtgaaagcggttcttacccatcccgctcaaggagaccttcatcatccaaaacaggcggatgtgccattttttcatgagagaaaagcgcttgcatatggtgaacagaccaatatcccccaccatatggtgaagccttatgatggtgaagtgccggattatacaaaatctctgcgggaggcgacagcacagctgagagccaaattgaatgaggatggttcggagtgggcaaagcgctcccttcataatctggacattttagaaaaagaatattttaaccggccataacccagtctgacaaaagattgggttttttacgtcgcgcgcttcaacagttcggttaaatcgattctctcgccgattgtgggcggttttggcttttcgagatactgcttatcctgctcaacaagcttaaaaagtttatatgctgtaagagcatcatcaagcgctttatgatgggtgccggttccggaatctccatactcttcggcagctttccataaacccgtcaatgtccggtctccaaaaaagtttttgtattcaagcgataaatctctcatttctcccttaaacgggaaagggatatggttaaacatacagttttgcttcagcactttcatatccatgtttccccacgtaataattgtgctgtttttctcaggatccagctcgtttagtttacggatgaaatcctcgaatctcattccttcgtctacctgtttttgggttatttttaaaaatgatttgcagcgtttcgtaagcttcgggaactttttcggtctaacatagctagaaaacgtctcaaccacttcatcatcaatcgactttacaattccggcttcaatgatttccgggaagaagttttgaggactgtactttccatcgggcattgtaaattcgaaatcaataatgagtaagctgtttgtcgtcacctttttacacctgcctttcctccgatcagaaaatgctatctttatagtatatcaatttcccttctcgacatttcttcattttctaaaaataatgaattttcccagccgcttcgtttcttttaaattgtgaatcgtttctttataattagtaaggaacccgaaataataagaaggtgatgttatatctatccgtaagaaaaactttgtcattgtgtggctggcgaacttttttgtctccgctagcacaacgatgatcgttccttttctctccttatacattgagacgctcagctctttttcaaacggctttgtgcaaaggtggagcggctatgtgttcggcattacatttctcatggcgtttttggtatccccgttttggggacggttcggagacaaacgcggatataagaaaatccttatggcaaccggaacaggcattgccctcagcattttcttcatgggctttgttacatcggtgtaccaattgttttttctgcgtatggcaatgggtcttgtaaccggattcatcccaacatctcttgcgatgatttcggcacagactccgaagagctcagccggcaaaacgcttggcacgctgcaaatggggcaagtgtccggaagcttgttcggcccgcttttgggaggcatgcttgctgatcgtttcggctttacgtataccttttttatcacatcctttgtgattttctcgtctgttcttctcgtgttatttggtgtcaaagaaaagcctcttgcagagaaaacagccaaacgtacgtcttactcgagaaaagaagtgctctcctatatttttcaccatccggcgctgtgggtcatgatgctgttaaccatgctgattcaaacaggcaatttcagtatccagcccctgctcgctttatatgtaaatgagctgcacggacctgtcaatcttgcctttttctccggcatggcattttcagcaacggggctcggaagtttgctgctggctagaaaatggggtgatctgggcgaccgctacggccaccgccgcattttaatcggacttttgctcgccgcctctttcttttttattccgcaggcgctcgcgtcctcactcagcgtgctccttgttttcagatttttattcgggatggcgatgggcggtttgctgccatgcattacggcagcgatccgcgttcaggctcccggcagcattcaaggtgaagttctcggctacaatgtcagctttcgctttttaggaaacgtgctcgggcctctgctcggcggaatcatatcgagccattttaccatttcggccaccttttacgtcacggcgtttctctttttcgccggcgcctgcatgctttggatcatgcagaaacttcggaaagattcttatgccaaagcaagctgattccgagaaaaaactgaggaatcttctaaatttaaccttctcgtaatctcaaaagaatggtacgatatggctagaatttaggagaaaagagagtgaccatgttacgaaaaataatcggatggattttgctcctttgcataatcccattgtttgcatttacagttatcgcttccggaaaagaagtaaaacaaatgaagtccctggatcaggtgcttgataaaaatattaatctgaaagatatcagccttgttcagaacagctacatgtatgacagggacggctcccttgtctcggaaatcgtcagcgaccacgaaaaccgtgtgctcgttccatttaacaagattcccgaggaagtcaaacagattttcttaacatctgaggaccgccatttttacgagcataaaggctttgactttatgggaatggtgcgggctactgcttctaacgtaaaagacaagaaaattgaccagggtgccagcaccatcacacagcagctttcaagaaacttatatttgagccacgaacgctccttcagccgcaagctgacagagctcgcgtattcctatcagctggagaaaaaatatacgaaaaatgaaattcttgaagcttacttaaataccatttattttaacaatggtgtttatggcgtcggttcagcagctcaattctatttcagcaaaccgctgaaatctctcacagtgggagaaatggcttttatctgtgctatacctaataaccctacattatatgatcctctcaagcattttgactacacgaaaagccgtcaagaacgtttgcttaaagggctaaaagatgccggggtcattacggacaaagagctgaaaaaagccgtaaaacaaaaaatcaaactggatgttgaaaaaagagaagacaaatatcctgactacgtttcctacgtcaatgatgaattcactcagctggtgtctgaatcagaaggctttgataaacgccttcaaaaagcatcaggaaaacaaaaagaaaagatcgagaacgagctgtccgcaagagtcagcactctgatgaaagacggcgtgaaaatttatactgcacttgatccgtacatgcaaaatcaagttgtggcacaaatgaattccaagctcccgtatgcggacgtacagggcggagcggctgtgattaatcaccagacgcatcaaatcatcgctctatccggcgggaaaaactatcaaaaatatgactttaaccgcgcctaccaggcgtacaggcagccgggttcatccattaagccgcttcttgattacggcccttatattgaacagaccggcgcgacaggaagcagcaccattgatgccagcaagttttgcagcaaagactactgtccgcaaaactacaataaccgcacttacggcacagtgacgcttgatacggcgtttaaaaattcatataatacaccggctattagaatgctcgaccgcgtcggcatccaaaaggcattcagttatattgagccgtatcattttgccaaacttgtcgacagtgactatcttcttccggcggcgcttggcggatttacaaacggcatgacgcctcttgagatgacaaaggcttatacgacattcggcaacagcggaagctatacgccgagccatgcgattacaaaggtgacagaccttaaaggaaaaacgctttataaatggaatgataaagcgactcaaatattcagcgtccgcacgaacatgcagctgaaaaaactgatgtcttccgttgtgaaaagcggaacagggaaaaaagcatatttcaatgcgccttacatcggcggtaaaaccggtacatcaaatgattatcacgatatgtggtttgtcggcctgactgatacgtatacaatgggtgtctgggtcggaaaggatacaccgaccagcgttgaatatcttcacagcatcagccctcagctttccatctggaaaggaacgctgcaagcggcttattaaaggatcggaggggatatggggtgacttcagaacaaattccaaatcgcgttttgctgtttgacggtgtctgcaatttatgcaatggagccgtgcagtttatcattaaacgtgatccggacggattgatttctttcacatcgctgcagtcggaaacaggacagagcctgctgaaaaaaagcgggcttccgactgatcggtttgacagctttgtctttattgaagacggccaagtgtacacaaagtcaactgcagccattaaggttttcaggcatctgcgaggcccatggcggctcttcgtcctgtttttcgcagtgccgaagcctgtcagagatatggtctattctttcattgccaacaaccgctataagtggtttggcaaaaaaaatgaatgtatgctcccctccccttctattaaaaaaagatttttaccgtaaataaaaaatggctaggacgctagccatcacagattgttgacaaaatcctaaaacggcttcgttttaggattttgtcatctattcagcgtgattgaaaacttttgaagttgtgaaacggcggaaacctgagaatctaccgccgtttcattgcgtacagagcacgaagcgcaaatctgaccaccaaacgctgaaatggctagctacacaggtaagctagccattatgctattataaagcttgataaatatgaacagaataccgataacaaaggtaaaccaaaacagcagttccaatagaatgaatccgactaatgacatgagagaaagcgtcgaataaatccggtacacggtaaacacaaagtaagcgagcgtgacgaccgcaaaccagatcacaatccaaatgacattttgcaagagcacaaaggataaaatcccgccgcccaaataaatcatggaacccattctgagttttttcaggttgttcccttccggatcattagcaaaaaacagcaatgacagctcggtcacggtatttgcaattaatttcagagcggacagaaccataaaatataaaagtgcaaaggcagcaaataacgcaagcctgattcctttctctgaaaaataatcgagcattccatcatacattccaaatgaagacagcatcttcaacgcataaagtgaagttgagatggataaggacgaactaaaaagcaggatcgcaatcagcggaaaatatcctgtcaaataagtatttttcatataaaaaagtccctttctatattctacctcatttattatggaggacttaaaacacattgacaagataaattattccattttttctcctttttacgaattacggtcccaaatcttcacaaagcagcattttgagagtaaagtagtacgcaggaatcataaaacgtaaggaagttttatatgaaaaaaacattaaaactgcaaaccagactcaccatatttgtttgtatcgttgtattaatcgcattgctcattacgttttttacagtcggtgcccaaaccaccaaacgaattagagatcaggaaaaggccactgcgctgcagactgctgaaatggtagctgaagcgccgatgacagccgctgctttagaaagcggaaaaaaacaaaaggaactgcagagctacacaaagcgggttcagaaaattaccggcacggaatttgttgtcgtcatggatatgaacggtatccgcaaaactcatcctgacccgagcaaaatcggaaaaaaattcaggggcggtgatgagtccgaggtattaaaagggcatgtccatatcagcacagcctctggcacgctcgggaaatcgcagagagcgttcgtccctgtctacgcagagaatggaaaacaggtcggtgcagtcgcggtcggcatcaccgtaaatgaaattgatgaagtgatcagccatagcttacggccgctttactttattatttgcgtcagcatcttcgtcggtgtgatcggagccgttatcgtcgcccgtacagtgaaaaatatcatgtacggacttgaaccttatgaaattgcgactctgcttgaagaacggagcgcgatgctggaatcgacgaaggaaggaatactcgctgtcgatgaacatggcaaaattaaacttgccaacgcggaagcaaaacgcctattcgtcaaaatgggcatcaacacaaatcccattgatcaggatgtagatgacatcttgccgaaaagccgcttgaaaaaggtcattgagacaaaaaaacctcttcaagacagagacgtccgcattaacgggctggagcttgtgtttaatgaagttcctatccagctgaaaggacaaactgtcggagcgattgcaacattccgcgacaagaccgaggtaaaacatttagctgaacagctttccggtgttaaaatgtatgcaaacgcactgagagcgcagtctcatgaatttatgaacaaactgcatgtgatattaggtctcgtccagctgaaagagtatgatgatcttggagattatattaaagatatagccatacagcaaaaatcagaaacaagtgaaattataaatgatgtcaaaagctccgtactggccggttttctgcttggaaagcaaagctttatacgtgagcagggcgcaaatcttgatattgaatgcaacggtgtcatcccgaacgcggcagacccttctgtcatccatgaacttattacaatcatcggaaatctcatcaacaatggcttagacgccgttgccgatatgccgaaaaaacaaatcaccatgtccatgcgcttccataacagcatacttgatattgaaattaccgatactggagcaggcatgtctgaagaagaccaagccaaagtatttgaacaaggctattcaacaaagggcaaaaaccggggattcggcctttatttcacacagcaaagcatcgaaaatttaaaaggccaaatgatcctcacaagcgaaaagaatgaaggaacaacattcagtattcgcatcccgtacgaaccgaaggaggaaaatcatgattaatgtactaatagttgaagatgaccccatggtgggtgaattaaataaacgatatttaagccaaatagatggctttcagctgaaaggcatcgcttcttcctttcaaagcgctctgcatattttaggcgagcatcatatcgacctcattttgcttgatatttatatgccgggaaaaaacgggctggaactgctgacggaattgagagcccaaaatgaagcggttgacgtgattgtcatctcagcggccagcgagcttgacgtaatcaagaaaacacttcggtacggagctgtcgattatttaatcaaaccgtttgaatttgaacgtttccaaacggctttgtctgattacagacgaaaacaaaaggtgtattcaacccatcgcaacatgagccaaaaagaactggacgccgagctttttcaaaagaaagaagcaacagaaaaagtgcagcttcctaaaggcctgacaaaaagcacgctgaagctgatctggtccagtatccagtcatttgaaaatgaatcttttacgacagaagacttggcaaagcacacagaaatctctcaagtatccatacgaaaatacttaaagtttcttgaagatatacaagttctgaatgtagaaatggcgtacggaacgatcggaagacctgtgtttcagtacaacgtcaacaacagtaaccttaacggaataaagcaatatctataagaaaacgcactgcttgctttgagcagtgcgtttttctgtcatatctcttgccaagatgcttgattctattgttgataagttatacaagaataacaaagggcctttcacatttttaagcaaataattctaaaaatagatactttttaaaaaattatgcgaaattctatttatttcttattagttaaatgataaattatgattggttagttgatcccgaaaaactaagtcataagtcttacttcagaaaacgatgtcacggttttccgcccggaacgccttccgcatccttctcttccccgcctttcgaaggaaatactcacaccacgcttattcagggaagaatagaactgtctcagcgcattccatttgttattatcagaaaattttatcgattctaagaaattgttcaggacagcccatcacatgactggccggatcagctttgaaccaaatttttctggggggttatatcttgaataaacgaaaaatcggattggcgatgtcacttgtgatcgcagcaggcaccatattaggagcatgcggaaacagcgaaaaaagcagcggctcaggcgaaggcaaaaacaaattcagtgtggcgatggttactgacgtaggcggagtggatgacaaatccttcaaccaatcagcctgggaaggcatccaagcctttgggaaagagaatgggctgaaaaaaggcaaaaacggttacgactatcttcaatccaaatctgatgcagactatacaacgaacttaaataaattggcgcgtgagaattttgacttaatttacggcgtcggctacttaatggaggattcaatcagcgaaattgctgaccagcgtaaaaatacaaactttgcgattatagatgctgttgtcgataaagacaacgtcgcaagtattacgtttaaagagcaggaaggctcatttctcgtcggagtggccgcagccctatcaagcaaatcaggaaaaatcggctttgtaggcggcatggaatcagagttaatcaaaaaattcgaggtcggcttccgtgccggcgtgcaagcaattaaccctaaagccgttgtagaagtgaaatacgcagggggtttcgataaagccgatgtcggtaaagcaaccgccgaaagcatgtataaatcaggcgtagatgttatttatcactctgcgggcgccactggcacaggcgtctttactgaagcgaaaaacctgaaaaaagaagatccaaaacgcgatgtctgggtcatcggtgtcgataaagaccaatacgcagaaggccaggtagaaggaacagatgataacgtcaccctcacttccatggtgaaaaaagtagatacagtcgttgaagatgtaacgaaaaaagcgagtgacggaaagttcccgggcggcgaaacacttacctacgggcttgatcaagacggagtcggcatttctccatctaaacaaaatctatcggatgatgtgatcaaagcggtcgataaatggaagaaaaaaatcatcgacggattggaaatcccggcaactgagaaagagctgaaaaccttcaaagctgaataagaatcgcagggataaggaggtcgagcccttatcccttgtttttcttttattttgaaataaaggagcggtcaatcaatggaatatgtcattgaaatgctcaatatccgcaaggcgtttccaggtatcgtcgccaatgacaatatcaatcttcaagtcaaaaaaggcgaaatacacgcgttgctcggtgaaaacggagcggggaaatcaacgttgatgaatgtccttttcgggctgtatcagccggagcggggtgaaattcgggtgcgcggcgagaaggtgcacatcaacagcccgaacaaagcgaatgaccttggaattggaatggtgcaccagcactttatgcttgttgacacctttacagttgctgaaaatattattctcgggaaggagccaaagaagtttggcagaattgaccggaagcgtgctggccaagaggtgcaggacatttccgatcgatacggcctgcagatccatcctgaagcaaaagcagctgacatatcagtcggtatgcagcagcgcgcagaaatattaaaaaccctctaccgcggtgccgacattctgatttttgatgaaccgacggctgttttgacgcctcatgaaattaaggaactgatgcaaattatgaagaacctggtcaaagaagggaagtccatcatcttaatcacccataagctgaaagagattatggagatttgtgaccgcgttacggttatccgtaaaggaaaaggcatcaaaacccttgatgtccgtgatacaaaccaagacgaactcgccagtctaatggtcggccgcgaggtatcgttcaaaactgaaaagagagctgctcagccgggagcggaagtgcttgcgattgacggcataactgtaaaggatacccgcggaatagagacagtcagagatttgtctctttctgtcaaagcgggagaaatagtcggcatagcaggcgtcgacggaaacgggcaatcagagctgatcgaagcggtgacaggactccgcaaaacagattcaggaacaatcaccttaaacggaaaacagatccaaaacctgacgccaagaaaaatcactgaatccgggatcgggcatattcctcaggatcgccataaacacggtctcgtccttgattttccaatcggagagaatatcctgctgcaaagctattacaaaaagccgtattcagcattgggcgttttacataaaggcgaaatgtacaaaaaagcacgcagcctgatcagcgagtacgacgtcagaacgccggatgaatatacacacgctcgggcattgtcaggcggaaaccagcaaaaagcgattatcgggcgggaaatagaccgaaatcctgatttattaattgccgcccagccgactcgcggccttgatgtcggagcgattgaatttgtccataaaaagctcattgagcagcgtgatgccgggaaagccgttcttctcctctcgtttgagcttgaagaaattatgaatctcagtgacagaatcgccgttatttttgaaggacgcattatcgccagcgttaatccgcaggaaaccactgaacaggagcttggtctcttgatggcaggaagcacgcaaaaggaagcggggaaagcaaatggttaaacgactctctcatttactcgtgccgctcatcgcaatcatacttggtcttgcggccggcgcgttgattatgcttgtgagcggctacagtgtggctagcggatattcggctttgtggaatggaatattcggagaaatctattatgtcggagaaaccatccggcaaattacgccttatattttatccggattggctgtcgcctttgcattccgaaccggactctttaatatcggcgtcgagggccagctgctcgtcggctggacagcagcggtttgggtcggtacggcgtttgacggaccggcatatattcacttgccgctcgcattgattacagcggcagctgcaggaggattatgggggtttattcccggcattttgaaagcgcgattttacgttcatgaagtcattgtcaccattatgatgaattatatcgcgctgcacatgaccaattacatcatttcaaacgtcttgacagatcatcaggacaagacggggaaaattcacgaatccgcctccctccgctctccttttcttgaacagatcaccgattactcacggctgcatttgggaatcatcgttgcccttctcgcagcagttatcatgtggtttatcatcaacaaaactacaaaaggatttgagctccgggcggtcgggtttaaccagcacgcttcccagtatgccggcatgagcgtgcggaagaatatcatgacctccatgcttatctccggcgcttttgcaggtcttgccggagccatggagggcctaggaacattcgaatacgcagcagtgaaaggcgcatttaccggcgtaggctttgacggtatcgctgtcgctcttctcgggggaaacacagccgtaggcgttgtactggcagcatgcctgcttggcgggctgaaaatcggcgcattaaatatgccgattgaatcaggcgttccatcagaggtcgttgatattgtgattgccattattattctatttgtggcttcaagctatgcgattcgtttcgtcatgggcaaattgaagaaaaagggggcgaactaagtggacattgtgcagattttatctatcattgtccctgccacactcgtctatgcggccccgcttattttaactgctctcggcggcgtgttttccgagagatcaggtgtggtgaatatcggcttagaaggcctcatgattatcggggcgttcaccagcgtgttatttaatttattttttggtccggaattaggtgccgccgcaccttggctttcgctccttgccgccatggcagcaggcgccctgttttcactgattcacgcggcagcggcgatttcgtttcgcgccgaccagacagtcagcggtgtcgccattaacatgctggcgcttggggcaactttatttatcgtcaaactgatctacggcaaagcgcagacagacaaaattccagagcctttttataagacgaaaatccccggtttgggcgatattcccgtcttgggaaagatcctcttttcggatgtctattatacgtctattcttgcaatagcacttgcctttatttcctggtttatcttgttcaaaacgccgttcggccttcgtatccgttctgtcggtgagcatccgatggcggccgatacgatgggaatcaacgtatataaaatgcgctacatcggtgtgatgatcagcggattgttcggcggtctcggcggcggcgtatatgcctccacaattgcgcttgatttcacgcactctaccatctccgggcaaggctttatcgccctggcagcgcttgtattcggaaaatggcatccgatcggagcactgggggccgccctgtttttcggattcgcccaaagcttaagcatcattggatcgctgctccctctttttaaagacataccaaatgtgtatatgctgatggctccttatgtcttaacgattctcgctttaaccggctttatcgggcgggcagatgcgccaaaagccaatggcgtgccttatattaaaggaaaaagataaacattctcccctgggaagacgattctcagggatttttttctaatccaaaagaccctcttaatttaattgtttattagttttttaacttaaaaaaatatgaagtgttaacgctttcttgtagactgtaacaaacaatacatgggggtgtatgacatgggagcaattccaaaaacggggacaatttcacctgagcaaaaagactcacaggggaaaaacctgtttcaaaaaatctggtcttgggaaatcggtgtgattcctctgcctttatacacagtattagctgttattattattcttgcagcctattacaatgagctgccggcaaatatgcttggcgggtttgccatcattatgattcttggtgtgtttctcggagacataggccaacgcataccgatattgaaggatattggcggccctgctattttatctttgtttgttccttcatttttagtcttttacaatgtactgaattcaacatctttagacgctgtaaccaacttgatgaaaacgtctaacttcctttatttctatatcgcttgccttgttgtgggaagtatcctcggtatgaacagaattgttttaatacaggggtttatcagaatgttcgttccactggttgcaggaacgatcgcggccgttgcagccggcatccttgtcggatttatttttggctatagtgcctatgattcctttttctttgttgttgtcccgattattgccgggggaataggcgaaggaattttgccgctttcaatcgcctactcacaaatactgggctcatctgctgatgtatttgtgtctcagctggttccagccgcaattataggaaatgtttttgctatcatatgtgcagccttaatgaaaaagcttggcgataagcgtccagatctaaatgggaacggacgtctcgtaaaatctaaaaaagcaaatgagattttcaatcaaaaagaagccgaagcaaaaattgatttcaaattaatgggagcaggagttctgctcgcgtgtacattctttatttttggcgggttattggagaaattcatcttcatcccgggcgcgatcttaatgattatttcagctgcggctgtcaagtatgcaaatattcttccgaaaaaaatggaagaaggcgcttaccagctttataagtttatttcttcaagctttacatggccgctgatggtcggtctcggcatcctctttattccgttggatgacgtagcgtctgtgatttctattccgtttgtcatcatctgtatttcagttgttatcgcgatgattggttctggatatttcgtaggcaagctgatgaacatgtatccggttgaatccgcaatcgttacctgctgccacagcggtctcggcggaacgggtgatgttgccattttatcggcatcaggaagaatgggccttatgccgtttgcccaaatttcaacccgtctcggcggtgcaggcacagttatttgcgcgacagtgctgcttcgttttttcacttcataaacagaaagagttccgttttatgcggaactctttttttatttattcacaatccgaatatactctcggggaccaaacggcagatcctttgattccgtctcactcattctggctgacaggtggtgctccagtaaatacagctcccactcatcacaagccgccacaccgctgcgcccgtcatattgattcaacatgaatgcccctgcaaatactgagcagaataaacctgagcacatcacgacttttgttttcacatgaccagctcctttccttcagcttgatcaggattgattttaaatatacaaataacctcttttttgttagacttattttgaggtcaaaagaactcataaaaacccattacagcagttcgaagcgtggcagcttgcagaaaagtgcgatataatttggactaggtcgtttgaccgtatatttcatacatagcgcatttttcaattgagaacgagaaaaggaggtcttatctttgcagctcttacatcttgctattttatcgccttttttatttgcttttatcattcccttcttggcaaaatacgcaaaaagagtgcatacgggctggtttgtgttgatcctgcccgtcttgctgtttatatactttctcccaatgatcaggatgacgcaatctggagaaacacttcgatcggtattagagtggattccgtcactcggcattaactttaccgtttatatagacggcctcgggttattattcgctttactgatcacaggcattggctctttggtcactctttacagcattttttatttatcgaaagaaaaagaacagcttgggcccttttatgtctacttattgatgttcatgggcgccatgctcggcgtcgttctagtagacaatgtcatggttctctacatgttctgggagcttacaagcctttcatcttttttgctgatcggctattggtataagcgggaaaagtcgcgctatggcgcagccaaatcacttttgattacggtcagcggcgggctgtgcatgctcggcggctttattctcctttatttgataacggattccttcagtattcgagagatggttcaccaggttcaattaattgccggccacgaattgtttatcccggctatgattctcattttattaggggcttttacgaaatcagcgcaatttcctttttacatctggctccctgacgcgatggaagctccgacgcctgtcagcgcttatctccattcagctactatggtaaaagccggcatttatgtgattgcgagattcagccctattttcgccttttcagctcagtggttttggatcgtgtccctcgttggcctctttacgatggtttggggttcattccatgccgtgaaacaaactgatttaaaatcgattttggcgttttcaaccgtcagccagctcggcatgatcatctccatgctcggagtcagtgctgcggcccttcattacggccatacagaatattatacagttgccgctatggctgccattttccatttgatcaaccacgctacctttaaaggaagcttgtttatggcagtcgggattatcgatcacgaaacaggcacacgggatatccggaagctaggcggcctgatggcgattatgccgattacatttaccatttccttaatcgggacattttcaatggccggcctaccgccgtttaacggatttttgagtaaagaaatgtttttcacaagcatgcttcgcgtgacacattttgacctgttcaacgtgcagacatggggcgttctgttccctcttttcgcctggatcggaagtgtatttacgtttatctacagcatgaaattgctgtttaaaacattcagaggaaattaccagcctgaacaccttgaaaaacaggctcacgaagcgcctgtcggcatgctcgtaccaccggtcattcttgtcgctttggctgtcagtctcttctttttcccgaatatattgtcgtacaccctgatagagcctgcgatgaactcaatctatccgacactgcttgccggccatgagaaattccacgttcacatttcacagtggcatgggattacaacggaattgctcatgactgcgggtattgttgtgatcggaacaattggttatttgtcgctgaataagtggaaaggaatctataaactgtttccttcgaaactcacactcaaccggttatacgataagcttttgactctgatggagaaaggctcttaccggatcacaaaacaatatatgaccgggtttttaagagattatttgctgtatatcttcgctggtttcatcattctgataggcggagcttttgccattaaaggcggattttcatttaaaacggaaggcatggctaaaatcggtgtatacgaaatcattttgacgcttgtcatgatcagcgccacagtggcgactgtttttgctaggtcaagactgacggcgatcattgcactcggtgttgtcggttatacgcttgcattgttttttgtcattttcagagcgccggacttggcattgactcagctcgtcattgaaacgatttctgtggcactgtttctgctttgcttctaccatttgccgaaactgaggctgaaaacaaaaacgagaacgttccggatgacgaattttatcatttctttaggcgtcggtgttatcgttactctgctcggcatcgcatcctcaagccagcggacaaaagacagcattgcgtccttctttgtcaaacacagccacgatctcggcggaggggataatgtcgtcaatgtcattctcgttgatttcaggggatttgatacaatgtttgaaattacggtattaacgatagccgctctcggcatttacagcatgattaaaacaaaagtaaaagaggaggggaaaagcggtgaatgaacaaaaaacaaatgacttgattcttcaaaccgcgacaaagcttgtatcctttatcattttgcttttctctttctatttatttttatcagggcataacgcgcccggaggaggctttgtcggcggactgatcacgtcctcttccatcgttctcttgctcttggcgtatgatttaaaaaccgtgcgttcccttttgccggtcaatttcatttatgtcgcgggagccggccttctgctcgctgtattaacaggcgttggctcctttgtcttcggggctccttttttaacccacacattcggatactttcagctgccgatccttgggaaaacggagctcgccacagcgacgatatttgatttaggcgtttatcttgttgtcgtaggcataacgatgaccattattcaaacgattggagaggaagaataatggaaatcttaatggctgtattagccggtattatttttatggctgctacgtatttgctgctgtctaaaagcctgcttcgcgtcattatcggaacagcactgttaagccatggcgttcatttaatgcttttgactatgggagggttaaagaaaggcgccgctccgattttgagcgagcatgccaaatcatttgtcgatccgcttccgcaagccctgattttgaccgcaattgtcatttcttttggcgttacatcattcatcctcgtcatggcctttcgcgcttatcaggaattgaaatcggacgatatggatcaaatgaggggaaatgatcaacatgaataattttgttattttgccaatcctgatcccgcttttgtcggctattcttctgattttcatgacgaagaatcttatgctcatgagaatcttcagcacggcggcatcggccatcgggattgtgattagcggcatacttgtacagactgtcttcacaaaaggtatccagacactcagcttaggcggctggaaagcgccgtacggcattgtgctcgccgcagaccaattcgccagcctgctcgttctcacaacagcggtcatcggtttattggttgggctttattccttccgttccgtcggtgaaaaacgggagcgctccttttactactccggcgttcagttcttgcttgccggtgtcagcggagcgtttttaacaggcgatttatttaatatgtacgtattttttgagcttctacttattgcttcctatatgctgattgtattaggcggcacaaaaattcagctgcgggaatcccttaaatatattgtgtttaatatcgtatcgtctgccctgtttgtcataggggtcggctttttatacgctgtaaccggcacgttaaacatggcggatcttagcgtgaaaatcagcgaatcaggacaaaccgggctgatcactgtgattggtgtcctgctgcttttggtatttggcatgaagggcggaatcttccccctctacttttggcttccaggctcttattacgcgccaccggcagcaatctccgcgttgttcggcgctttgctgacaaaagtcgggttatatgcgattgcgagggttttcacattgatttttattcacgatacagcctttacccatcagctgatgatttggctggcggcgctgactgtgatttttggtgtcatcggttcactcgcttattcgaatgtcatgaaaattgtgatctataacattattaccgctgtcggcgtgattttgttcggtgtggcagtacacacccccgcatctattcagggcgcgatctactatctgattcacgatatgctgattaagggcgctttgtttatgctggcaggtacgctgatcgcattgactggaaccgcgagcctgcataaaatgggcgggctgatcaaacgctatcctgttcttggatggatgtttttcatttccgctatttctcttgcaggcattccgccactgagcggatttgtcggcaaatttaaaattgcggagggcggcttcgcagaaggtgaatttacgatatccatgctgattctgctttcaagtctgctcgtactgtactctgtgctgaggatctttatacatgcgttttggggcgaagaaaaagaaacgccaaaaccaaatcatcgaacagctaaaggacttctttatccggcagctatttttctcttactgtcccttctcttcggattgggtacagaatgggtgtcgccttacgttgatcaagcggccgagacgctgctgaatccggaaaaatatatcgaagctgttctgaaggagtagatcgcatggcatttcaaattttattaaatgtgtttctcgctttttgctggatgttcttaagcaacagtccaagcgccgcaggattcattacaggctatattctgggaatgctctctctctttttcttccggcgctttttcactcgccagttttatctatggaaattgatttctattatcaagctctgtttcatttttataaaggaactgtaccttgctaatgtcagtgtgatgaaatcagtcttatctccaaaactgaatatcagaccgggtatttttgcttttaaaactgaactgacgaaggactgggaaatcaccctgctttctctgctcattacattaacgccgggaaccttggtgatggatatttcagatgacagaacaatactttatattcatgcaatggatatcgaggatgcggaaaaagcgatttttgacattcgggagtcatttgaaaaagccatacaggaggtgagccggtgatgtttacgctgatcctgcaaatcgcgctcggcattatggcagtgtctacctttttgtatgtcattcgtgtcattaaagggccgactgtgcctgaccgggtggtggctctggatgcaatcggcatcaatctgatcgcaatcacggcgcttgtctccattttgctgaaaacaagtgcgtttttggatattattttgctgctggggattttatcgtttatcggaacgatcgcattttccaagttcctggagaaaggagagattatcgaaaatgatcgaaatcgctaaggttgttgtggctgtattcattttgctgggtgctcttatatgcctcattgcttcatttggcgtacttcgccttcccgatgtgtttacacgcgctcatgctgcttctaaaggctcaacattaggtgtcaatatgattctgctcggtgtcttcttctatttgtggtttgtgacgggggagctctccgctaaaatcctgcttgggattctctttatctttattacgtcgcctatcggcgggcacttgatctgccgtgctgcgtataactccggcgtcaagcttgatgagagaagtgtgcaagatgactataacggaatcagaaactttgtgattaaacgaaaagaggattcttatttataaaaataagcagccggacaggcagagttccggctgtttttttatttcttgatgacagccagcgtgcatctggatatacagatcagcctctcttgctcgtcatatatgtgaatatgatagacaatcgtcgttctgcctatatgaacgggctcggctatcgcctttaccgttccttcctttacagattttaaatggttggcgttaatctccaaaccaacacaagcttgcgttgtatgatcaatcaggttctgtgcacctgcgctcgccgcggtttccgccagggccactgaagcgcctccatgcaaatatccgaacggctgtaccgtccgatgatccaccggcatgaccgcaacgcatcgttccgctgtgttttcaacaatctcaataccaagcgcttcaagcaatgtgtgcttcatatccatctctacaccccccaacatttaaagtacaccgtctgatttcgcaatcaaaaccgcttccgtccgtgaaccgacattcagcttattgaaaatcgatgtcaagctgtattcaatggaccacttgcttaaatgaagggcatctgcgatttcttggtttgtaaatcccttttcaacttcttgaagaatcaggcattctctaggtgtgagcacatcttgttctttttgagaggaaggagccggctttgttttttgctgagtcatcagctgtttaaagtaagcaaaatcgactaaaatttctccgttgagtacgtggtatatgtattgggtgatcttttctttagattccgttttgctgatggcaccgtgcagacccgcacgaatcgcttcctcgaaataatcctcgacctcataaccggtatacacgataattttacaatgaggattctcttgtaaaatctgtttagaaagctccatcccattgacctcgccgcctagattcagatccattaaaatgagatcatatgacgagaaatcatgctgcttgataaactgttcgctcggttcaggactgagacaatcaacagacaaattcgaatccgtttccaaaattgtcttggtgccttccatgacagccggatggtcatcaatcactagtatctttttcatgttttcctcccttttactcactcttttccattttataaaaaagacttggcctgtgccaagtcgtttccgttataaatccattacaattcgatttcaatatcagccttaaagccctttccttcacttgtttcaatccgaaggcgcccatctaaagccctgactctctccttaatgccagaaagccccatgctcatggaatgctcagtatttttttcttgatcaaacccaacgccatcgtcctcataatgaagaacgattttgttttgaatactgatgagcataatcagcacatccgtcgcctgagagtgcttgaccgcattagacagaaactcttgaatgatccggtacaaattcagctgcgaatccagatcaagggaagccgtaaatctcccggtatttaaacggatatgaaacggaacccgctcctgctgctgcgccaccagcttcgacagcgccttcaccagcccaagatcatacagaagctgcggccgcagctcatgacacgtctccctcgtcatcgaaatcacatcagacatctgctcattcatctgtacaagcttgtcctgcacctcttcacggcacggattatcatccttcttaaaatcacccaaaaacagctcacactggcgttttaaggaaatcaaatcctgaagaaccgaatcgtggagatcgcgggcgagatcagagcgttgtttttcctcgatcgtatacatgagttttttgagccatacggggttggattcttgttgttttatttcttctaaatgactcatcagttcttcgattttcatgacgttttcgatcgatacgtttgtataaaaagccaaagttttcagccaagaaagttcttcgagtgtgagacgaggcgtattcattttagataaacaaaggatcacaaatgatttaccaccgcgttcaccaatcttcatgacaaaacctttattaaattcaacgattttccctatttcggatgttacttttctaaattctttttcatagactttttcaaatgaatttacgttctcagcatcatatagtttaatatttccgtcagctgaaacttcatatacatgtgctcggctaacaagagaaacctcaagtatagtatttttcagttcttcaaatacttgagacagggaagtagagtctcttatcatctgcgtgaatttatatatactgtcttgataattgaatttttccgagaccctttttaatctaaatctgaaatcaagtacttctttataataaaagaccgccaacatgataatataaattaaaaaggttagtttaacactataaaaatcactatcaggactactaatcaattcaattgtagagattagaataattgttggcgttagagctaaaaagccatagtaccttaatctgcttaaaataaaatctacattatagattttatttgtcatgaattgaaatactaaggagaaaggtattagcatcataaatgaagctgctaaaaaggatgaaacatagtgcgcatttaaaaagacatacggtatcaaatataaacacaaaaaaggtgagaaagaaaagatattaataatagtgagaaccttaataatatgcgcttgttcagtatctttatttttaattaaaatgatacagaaatatatccctactatgataaataaaaagaaaaaggatagtaaacttaatttaggcacataatcacgaaagaaaaggtgtgaacgaaacatttcacacactacatttatgatcggtaccaaatataaaatgaaaacttttttatcaaataaggtagtgcctaactctctaaaataatgataaagaaagagaaggtagtttagcggtacagatattaatgttaccaccataatacatctgcatagtatatcgcctttaacagaaactcctgcacttatataagcaatagaagcggataacagaaatataattaaaactaaagcagatggtaaatcctttgattcgtttatttttattataaataggcaacaaaataaacaaacaatataaaacattaacggtattaggtaagtagaaaaatttttatcattaaataaagtcagctttagctcaacatccttgccatttctctcaacaaccattgagctcacatttttaagcttattcatttttatttctttagtgtttatcttttgattattaatacgctttacgatatcccctttttctattccactgtatgatgccattgaatattcatctacattggtaattacaacgtctccgttcttccctttcgaaacagttgctccaactaacaaattattattgcttatataggtcaaataaataacatataacagacttattacaactaacaatacagaaattttattggttctagacttcatttaaccctcaatagtgccaatccatcattgaataaatttctaatcctttaaaaccttttatgatacattcagattgatctttatcaacacccaataaacaagcattcccttccattacttcccttaaaacatttgggtatttaattaagtatcctaccatttcttgcataataaatcccctccttatttaatcataacagacaataatttttcagttttatcttcttctagttttaattgtgacatttcattttttattttttggagagataaatgtttcatcaccagtaaatattgtataacgcctgcttctgtcaattttcgcttcaaagccttagtattaatagaaacaaattcctctggtttttgatataaacttagtagctccgctgaagcatcgttaaattgtttatttaagtataagtatgccaatgtgtttttcttctgaataaaatcgttatttagataatataaacctcggtaatcattttcgatttgtgcaataatcccaagttcataagaataagaagctacaatgggatggtatttgcctgttgccagcattactcccattacacagggcaatgccgttagcgctcctgatttatttttgatcatttcaagacaggcttcttcagtttgcggcgcattcacaatatcatcatgctggccttgaattgattgtaacgcaaaattcaatatctcttgtgaaaattctggttcatgactagcttgacacatcacttgtatacttagggtgtaaagagctgtaactgcatttaaagcgattgacgagtcaatcttcatccagacagcacttccattatcttgatcctctaagtcatcataaatatcgaatgagagtataagcaattcaattccggcagctagcaattcgattgctttttggtcctgaccgttaaaagctaaataatgatgaagagccaaatcggcaaactcaaacgtatccttagactcaataaaattctgaagatatcgttccaagtcctgattcattattttttggcttacaatctccttcattttctccttgatccggacagaatctaaacatatctgctcaataacgacttcccccctcccattccattttactaaatgggacatttaaaggacagcaggtttttcgttttttaacaatcatataatactttatccatttattgtatcggtagaacgaaaaaaaagacttgtttccaagtctttttcacgaaattttcattgcataattgtatttatcgagttgatcaatgcttttgttaatgtttcgtaatgaatctgtcgtttctttaatatcaagttcgagtcggaataacaattgttttacttcttcaagtttcttttccatcgtttccacactcctttttttgaaagatcaatgaattgtgtatggtgaacgagtcctaggtatttgatctgttactaatagtgtatctgctttcggcttatttttcaccgaaaagtatacaaaaaagtcctgcgtgacaccgcaaatctcaataggcccttatactcaaaggaatcacaacaagaacgggactatctttctatgcgaaagagcgtttatatgtgctgaaattgagaaagattcttaatctccttgattttaacgggtttcgcattttcactaagcaagactatagtccttcataccgtattttcaaaattgaatatgcgattcttggcgtttcctgaccgacaaacaccgaaaaagaccgcaacgctaaagttgtggccttttcgctttgtcatattcggcaattagggatctatacatatagaaacatccttttttgcgaggtgctcccatgagatatcgttatccctggttttacgtgtatccgtatgaggtacgccgtccgcccgctcctgccaacaatattgatacctttatccgttcagcgaggcaggccgcagggatatttgcggatgcccagctcgttctcggccgcattgcgggctcgcgggagctctcgcgccgcattctgacggcagccgagcagtccgataaacaaaccatcaagcgcctgatcaaacaaatgggcgtccggcatgaagtggatacggtctttaatcccgacggcatctatatcagccttatcggaacgcaaagccgaatcattcttgctttgcggtggtcagaggaccgcaatcattttgcgtccataagattatgacaccattccagagcctcaagataacattcatacgcttcttctttgtcgagttgattgcctaattctgagcaagtgtcccagttgttgctttcaattaatttcacaagctcaagcatttggtagtagtcgttttgatggcctaataatgcttgcccgacttcatcttttaaaggcaattcttgaacaatttcctctatttctctatgcaggagggtgtctatgagagaaaacattccgatcagcatataagaagcaggctgcggccgggatgtctttctcgccagcagttcgcaaagctttgctcttatcaaagaaatcttaatgatttcgtgcttgctggaatgccctttcctgcttaaatccttaaaggaaagaatatatatccaccgtttgatttcattaaatcccagcagcataatggcctgttgaatgctttcaattttctggctcaaacggctgtgggatgagtttaaaaattttaaaatttgataggacagtgataaatcccgctctatgtactctgtcacacgctttatgttaggctgctctttactcagttcgttaagcagttcatagtaagaatagaaatgagtcgataggtcatgcccgctgatgatgcgcggctcgctgaaaaagtagccttggaataattgaaagccgtcttggaccgcctgtttatattcttttcgggtctctactttttccgctaaaaaaatcaggccgcggcagccgtaggtttgcaaaattgttctgcgttccattcgtgttgttttgagaaaatcaattttcaatatatcaatatagctcatgagtttttccagtaagtcctcatcttgcggatttattgcataaaaatcatcaagcgccagcatataccccatttttttcaattctttgcatctagaaatgagggccggcgtgatcggtatatcttcaaggatttcaatgacaagctgtttcggattgaaggaggtgggaagattcgaaaacatcaggctttccgtaaaattaacaaaacagcgtttcccttccgtcagcttctcaattccgatgtttaaaaagctgttgatcaccaaatctgttgttgcctgatcgccgtctttagcgctatacacgttctcttcgctttctctatacagaagttcataagcaacaacctgttcttttctattaaaaataggctgtcttgcaacaaacaccctcattgatttatcccccttacaatacgcgcggctttcacccctaagtatatcaaataatttgacgaaaattgtctaaacatgaaaaataatatatacataaagaaaactggcccttcgcgaatgaaaggccagtttttctttattcttcctcaagctcttcttcaattctgcttttcacttcgtggatccgctgcattttattgctccagcagtcctcgcttaaatcaaccgggtattcctccggcttgctgattctcttatattcctcccaaagcaggctgaggttatcctgcacatactgctgtatgtctgaaatctcaggattttggtagcaaagaatacccttctcaaaaatcagctcatgaagatccttcgcataaaaattcgtgacaaatttgctgatgaatgtatgaaccgggtggaacattctgagccgcttctgatcattcacctgctcatcataaagcgcaatatagtcgccttcagaatgatggttggactgattaataatgcggtagactttctttctgcccggtgtcgtcactttttcaggattggacgaaattttgatcgtgtcgaccattttcccgtcttcttcaatggcaacgagtttataaactgcgccgagagccggctggtcataggcagtgatcagcttcgtaccgacaccccagacatcaatgcgcgctccctgagcctttaaattcataatggtgtgctcatccaaatcgcttgaagcaatcaccttcgcatctgtaaatcctgcttcatcaagcattttccgggctttttttgacaggtacgccaaatcgccgctgtccagacggatgccaatgaaattaatgcggtcgccgaattccttggcaaccctaatcgcgttcggcatgcctgaacgaagcgtgtcatacgtgtcaactaagaagacgcaatccttatgtgtttccgcgtattttttgaaagctgtatattcatcgcggtaagcctgcacaagcgcatgcgcatgtgtgccggaaaccgggatattaaagcgctttccggctcttacattgcttgtcgcgctaaagccgccgattaaggctgctctcgctccccacatggccgcatccatttcgtgcgcccgtcttgttccgaattcaagcgcaacttcatcaccaatgacgcctttaatccgggcagcctttgttgcgattaatgtttgatagttcacaatgttgagcaaagctgtttcaatcagctgcgcttctaccaggggtgcctccaccctcataatcggctcattgttaaaaacgagctctccttctttcatggagtaaagtgaacctgtaaaagataagccgcgcaaatattcaataaaatcttcatgatacccgagttcatcctgtaaataactcaaatcgctatccgtaaacttgaaattttccaagtattcaatggctttttccaagcccgcaaatacggcatagccattttcaaacggaagccttctgaaaaacagctcaaaaatcgctttcttttcatgaatgccgtctctccagtacgtttccgccatattgatctgataaaggtctgtatgtaatgacaggctgtcatctttaaatccgtactctaacactgtttttccccttccttactctgccacttgcgctccgatgctgtttgcaaaatgggaaagagcccatgcgtgcccctcctgattaaagctggcaacagcttgtttatgcacaacaatccgaaaacctttgttatatgcgtcaacagctgtatgcaacacacaaatatctgtgcagacaccggcaaggtgcagttcgccaatctgccgctctctgagtttgagctctaaatcagttcccgcaaaagcagaatatctcgttttttccatgtagtaaacattaggttcatgttcatgtttctgatatagaggcaaaagctttccgtacagatcttttccttccgtgccttttatattatgcggaggaaaaagacgggtttcagggtgatattgatccccttcatcatgagaatctactgctaatacgacgtaatcaccgtttgtgatgaattcttcagttaaattgacgatcgcctcttcaatcattctgccgggctccccgcaggtcaattttccgtcactcgccacaaaatcattcgtataatcaatacaaataagtgcttttttcatagccggcctccccgccatcagtatgagaacattatatcttatctccagttgtaagtgaattgccatgaacaaaaagacaaacggtccgtttgtctcttaagatttcagcactgaccgattataaatgtcgtcctgaatatatatcaattcacgattcacagcgatgtcagccgcaatgacgatgcctaaaggcgtatgaaactgaagatcagatacaatcttgaagggcactccgtaccggttcgccatttggatataaggagagtaagactgatactgaagctctccattaatcaaaagggtgacgttatggctgtttttcagctcgtgctccgcctctttatacggtttgcttctaagcacctgtcctttcgtcagtgccaaaacgactctttctcttagagaacctaaaaacaagtggcgctcgtcaggctttgtctccaaaggcccatacattccttgctgcaaatagagatccattttatcttcactcaaaagcctgtcctcccgtcttgtttgtcttcattatcacctgatcaggcaggagctaaactttcaagcgccgtttacatttctgttacccaatgaatgatttttttggccagctcaccagcaggggtttcctctgtatgccggcgcaacgacgcttccagccgttcaggcagagttgctttatcttcttcataggaaatgatcgtgctccactccagctgcggtaccgctacaagcgtgcgcagttcttttctgttttcatgcagatacacgtccgtgatcattccggtttgcgtattgatatttgcttttctgattttcataacatgacctctctattcaaagactacccatattatacaataaaaaagcaacagcctcttgtgaaaaggctgttacccgttaaacgaaactgtttcatcagtgatatcggcatctttgaaaagagttttacttgtttggttgttaatcttcacaaaatcaccaagctgaaatgtgcctgaccccgcccctgaatgagcgacgcttttgggcgaaatcgcaaatacatctccaaagcttgccgcggcattatccgtaactgacatgatataaatcggccccacaattgcaggcatttccccacctccgcattgatttacagcatcatatgcaaggagccgataatggtgcccgcctattcagctggctttgctttttcttcgagtcgtgaccgctggcgcagcttgatcaagcggacaatattcaggaagaacgccttcactaccgcataaaccggcaccgctaaaatcatgccgagaattccgccgaagcttcccgctccgattaatagcaaaataatcgtaagcggatgggtattcagccgctttccgatcacaagaggagacagcaggtttccgtccagctgctgaacgatgacgaccacaataattgcaaacagcgctttggccggcgagtccataaaaccgacaatgacagccggcgcggcaccgagaaaaggcccgacatagggaatgatattggtaatcgccatgacaatcccgagaatcagggcatacggcagtccggcaattaaatagccgataaaacacgctgttccgacaaaaagacagattaacagctgcccctggaaatatgccgcaagcgtatcggataaatctttaaaaatctttaagccttctgtccgataagaagccggtagaatttttactgccaaatgcggaaagcggtgtccgtctttcagcatgtaaaaaaggataaatggaacagtaataataacaagcgtgatgtttgtcacgacaccaaacaccgcagataaactggacgtgatattttgcggcaggttttggagaaaacttgtcaatgactgttcaatttttgatatcgatacataatcctggttcatcatccaggtaaaccattgagaatgggacaaatccttggtcagcgcctgaatctgttttatataatcaggaaggttgttaaacagccctgtcacctgtgaggtgatgataggtccgactgacgctgaaataaaggcaagcaaaccgataaacagtaaatagatcaatagaatcgataatgtccgcggaatttttttctcaagcaggcggaccaccggattaaatatgaaatacaaaattcccgcaattagcatcgggaaaaacaatgtcgagataaaaacaataaacggctgaaatacaaatgaaacttttgttgctacaaaaataatcagcaaaacaaataaaatctgcaatgtccaaaaatggacttttgatttcaacaagctttgttcctcctagtttttctttgtctgtcagataaaagaacttataccccatcattgtaacaaaaatgaactcatatcagaactcttaatataatgaaaggagtgtttgtgatgaaggccgtgacatacgatacagattcagaactggcttatatctatgttcatcctccggaaaagaacaggaatatgcggtctgaggagcttaaggtcaatgattgtatcctgctggatattggccaacagacggcaaaattgctggattcgaaggttttggtgaggcagcacacctctgtgccccatttaccgggaaatcccggctatatgtaaaagattcagacggttatcattttcgggtctgccagcatgcttcagtccgttcctgctatacggtgtacggtgtcactttctgtttttcagatggtgacgatcaggaatttgccggctttgaccttgatggaacaatgtatcatagtgcgtttttacagcgcttaactgaaaaataggacgtcccggtgtacgcctatttttcatgcgcaagcactgttagacccgctcactgtaatctggggtgacggaaatcatgtgctggattctgatcaaacaaacagaatttcgggctccttcaattgtgatatggtcaggttttacatcgatcagtctgcctctgaccgtatctcgtactgtctgtataacgaaccttgagccgatgagctttttaatggtctgatagacataaggatcgactaaagagaccagttgcggactaccttggttgaccatacttttatcccctttgtgtgttttatctcagcttatgccgcgcttatggataatgacacaggcttacctgataaaacaaaggggtgcggagattttaggagaatacgtttggaagcggtgtaaaggaagtatcgatgaagcggagacagcgaagaaagctggcgctgttccgtacttatacaggctttatcacggatgcctgggcttggtcgattaattggtccagcttttctattttttttcgtgcggttgaaggatcaatttggcggtaatgatggtggccgcccggctcttcatccagttcgtccgcttttttgacaatctgctgcagtgtgtttttatctaattcgccttcaggcaaataggaatctgtatgaagcaaaatggctagtgcaatctcttttgctgctttcggttcctcgccaagccgaatcagaagtttatgcgcccgttccgcccctttaatggcatgaatgtcatttcttttgtatttctcataatcccactttccgtctgtataccattcataatggccaatgtcatgaagcagtgccgcttttgctgctaaatcaggattaatgtcagccttcacagacagcctgtatgcatgataagcgcaggcaatcgcatgtgccacgccggaacgctgaagatatttttgtgcaattggatgggtgaaaacatccattaatgtaacctttctcatggaaacccctcctttagatatttttagaatcctaacataatttgcagagaaactcaattcttatgtcacatcattttgatcttcttatcatcattgttataccctaaaagcaacgtttcagtcagtatatgcggctgttcaataaaatgcgctggctgtagccttttgtataaaaaaagagcagaaaatatctgctctacaaaaactctttaatatcataaatgcggccgttttccgtccctttttctagtaaagaaagcagcgtgccggcaataaagtccggactgcgaaggcttcctgtttcatttaatttccggaatcgttcaatgtggtggaaatcctttttcgatgaagaacggatgacggcctgcatctcagtgtccatcactccaggtgagaacgaaatcatgttcaccggcagctcttcatcctcctgttcaaatccgaatgtcctcgtaaacatgtcgagcccggcttttgaactgcaatacgcgctccatcccttatatggatttttggcggctcctgaagtaatgttgacaaccgtctttttgccgctgtatgaagcaaaccgttttgtaaacagctgactcaaaagcacgggcgcagtcaggttcagctgataatggcgctgaagctcgtcaagagacgcttcgccggcacgtttgatcggcgttaccattccggcgttattaataagggtaataccagaataacgatctgaatcgatggatgagagcaatgtttcaaattgctgttcagcttcttcgagattgatgaggtctatttgatgctgcgttagtttttcatgagagacatccgttttcgttctggataaggcatggacttcatgccccttttctaaagcctgtaatgcaatggcttgacccagcccttttgacgctccggtgatgatataaagttccattggaaacctccttttccgttattattgtacggcaccgcttttacacaacacaagcacgcggcctacgccttcttgttttcctgcgctgtgacttttgggatgaggaacacgatgcctgcaattccgagcaggatcagtacgacatagatcatcggcagcagcaatgatgatgtttcttgttcatcttctgtttccgttgatgatgtctttgttattggtttttctgcaaatgtaattccaagctgtttcgactgggccgcaatcgtgttggaatcctcggcatttgttgatgtaaacaaatcttttatcagctcggcgtccttgtccttcggtttatcaaaagtgatatccttttgttcctcaggcagttctgttttttcttcatagtaggtatcttcatgcaaataattcgtatcgatttcgatgtcttttttctcatactggtttggcgcgacatctgtattttcttcagtttgggcagcagctgcagagggtatgaaaagggaaaaggagagcatacaaatcatgatccccttttccatgctgcgatcacgcttcatacgtttcatcgctttctgctgtgtgttcagccatcagccggataatcagcggcagagccgcggcaatcaccgtaatgatcagcagaactgttattcccattgtaaacaagtgcccagtaccgtactggatgtcgatatatactttcgaaaccggatcttcaaatgtaaagttcggcatgatcaaatcaataagcggtgcgacatagaatagaatcattgccgctgaagcaacccagccagggattgatccgaatctgaatgccgtccggatgaaggcagagcttgcgaccagcaatagaatcgtaaacaccgaccacttaatcgtctgatcgtccggcagtgaataaatattcaaaccgaacaagctgatcataagtccgacaaggatattcagaattccgaataacgctcctttgacgagaagcggtgcgttttggtaatacgagctgaaatagccgattaacagactgctgatcaacacaatgacaaggatgacaaccggaggtaccgtctgaattttttcttccggaacctctccgctgattttaagcggattcgctaagtaatcatatacatagccattgttttgcccgtctactaatgtatttccgagtatgccgtatacgtcatttcgcacgagtttcgtggaggctacatttttcccccagttgttgtttaaggtgtcggctttcgcttgaacatcattgacgctttgctgcatgttggttgtgtaatcaatgatgcctgactggcgatcagacaatgaacccatcatgtctgacatttgcagcacttcctggccgaccgtatcttggacactcagtgccatggtgccagacagcccatcgttgctgaacgtcgcagattcctgtgttgcgcccgttacaagctgttctgacgcttttgcggcactttcagagattttcgtcagttcgtcgagaacacctgcttgagagtcacggatatagccgctgtagtcgtccgcaaatttggtcatgccgtcgatgaagctgttaatgtcttcatcagtttgcatcgtgttgtttttgagagcttcccagctggctgattcttcaggtgtgagagccaggactgattggacgttgctctgctggccgttaatggcgccggcttttgcagcactgtcaatcgtaccggataatacagagtcataaacagacaaatatttatagtatctcattaaagcggagatgctttctgtattgatttctcctgaaaattgaagctgatctttattttcaagctcgcgaatcgcactgtaaatcccttcaaactcccgcttccgtttcgcttcgagtcttttgagattatcatcgagtgttttcacttggtctttgagatcatctatttcatcatttagaccgtccatttgctctttcaattcttgaagcttcttcttcagtgcttcattatgtgtattttctttttccttcagctcttcttcgatttgcttaattcgttctgacgctttgctgagctgttcttttgctttggcgatatcagaaatgtcatcgtttcctggttgatcttggtccccaggctccgtcgtatctccgccgctaccggtatctcctgaatctccggttccgccttcatttgccagcttgataaattgaagggctgaatcagaagatgcagtctgttcagcagatgtgcccgtttcggtttgtccgctgtctgacgcatcgctgggctgctcctgaccgtctgttcccttctgctggtcttgatcctgagtactgccgtccgtttgtccgtcattaccggtatcactgctgttattgtcgttccctgtgtcgccctgtgtatcatcgggatttgtactgcccccgtcatcaggtttttctgggttatcagtggacggatcgtctggttcagtacccgggtcctccggtgttggatcctctttttcaggctccttcagattgtctgaaatatcctgaatatcagcagcgatatttttcagttcttcacgctgtttttcaagatcaattttgagttcttcaggatcatcttctttagggtctttatctttatcattgttgtcagagccatcgtctatgactgggtcgtcccctttctcaacagttagcgccggacgcgtcaaaacaagcagttcatacacctgatttagtgcagcctgccttgatgcgacctggtattggttaattaaatcgctttgtatcttcgccataccaagttcctgctgaggcacttgactctccctaatttgctgggcgtttgccagcacattactggtttgtccgagctgtgtcttcgcttggctgatcccggttgccaatccgctcatgcgttcgctgaactgattcgccttttgctgtgcctggatggcatccagacctgtccggatttgctgctgtgttgaatcttgggctgccaaaagtagctttttctgattttcttgatattctttgtatctttcaactgtatcaatgaattctttcagcgtatttttggcttcctccgctgtagaagctttttcttttgtcgtgccttgcgcttcattcattgatttcttcagctcatcgattaagtctttttgctgtttgatttcacctgctaaatcattagagcttggtttgtaaaagttgtacatgacattctggaattcagattctttattgacgatcttgtcaaactctcctctgatgttgtccactttttgtgaaacaaaattccagtataaggccgacatttttttgttcattgtcttttgggcatcctcaagctcacgctgaactttttctttgttaaccgcattcaggttatcttgaatgctgaattcgagcgttgctttttgaggatggtctttgtcatagctcaaaatgttttttgagaagtctgagggaatgtagacgatcgcatcgtatttctttgaagcgagaccggtctcggccgcgcttcggtttacgactgtccacgaataatcaggacgttcacccagaacggccgctacttccttaccaaactgggcggatttgtcctcttcatcagactttacctcatcactcaatacgcctgtgtcttcattcaccaccgcgatttgccgggtggaattgactgcttttttcgtcgggtcgtctccgataaatcggaaaaacaaaaccggcagcagcaaaatgatgatgacggcggatattaacttgatcaagctttttcgttgttctgtcatctagcactctccctttcagcagaacataaaggaatttgaactttttgctccttcccgttttccacaacatatccgaagccgggctgaatctcaggctcctgtctttggtacgggagaggaatgacattttgctcagactttttcatcagcagaatcgcgtggcggatttgcttcatctcagtcgtcaaggagtcatagccttttgagaattcgctgtgatttccgcccgggataaagctgaacccaagatgagcgtatgatttcatgaagttagcgagacggtcttgtattctcgtatcaatcgtctgctggaatctcgttatcccgtcaatcatcagcaccacttgtgagaatcgcagattttgcgcgtctccttggcggacggcttccacatacatggcctctctagttttgaaaatgtcttctgctgtttcaatccactgctcaatatcttctttcgtttccaaatatgaaacagctgattccttcgcataatgagataagccgcggtcaatcgagtcaaacaggccgatcatttcagtttcatcatcaatcagatgttcgagcattacttttaagacgtttgttttcccgcgctgagtctggcctaaaatcaggcagtgcttatgcttgcccaaatcaaaatagactgggctgactgtttcttcatgaagcccgatcggtacagataaaggcttgcgttccagcttgaagcggatagaaaattctctcgtagacaagctctcaggcagcatcggaatcggtgccggctgctccattgcagcaaatcgcccttgaagtttctgtacgtctgatttcagctcgttgaacatgccgatatcatcctcggcgtcaacaggcaggaacatttgcgcgaaataaagctcttccttttgaatgataacgcgtcccggaatcggctcaagattgaacttcggacggccgtaaatggaatatccttctgattgatccatgagataatggacaacctttgttttcaagttatttaacaatgactggcggacagcattcacccgcgttgctgtcaacataaagtagatacccaagctttgtccgtctctggaaagctggacaaattccgattcaagctcatgcatctcatccttgacaatgtcaaagttgtcaatggtgataaagatgaacggaagctcttcttcgctcagcgcattgtacattttgatgtggctgatttctttttcccggaacaaacgtttacggcggtcaatttcttctttgatgcgaatcatgaacttttcaatttttcttgactggtccatcaggaagtaatccgcggtatgcgggagcttcgctaatggcagcagcgttccgtttccgaaatcaaagatatagacatgaagctcttcaggtgtgtatacgtccgcaaaactcatcaggaacgttgcggctgcaatcgattttccgtagcccgaagagccgaagatgccgatatttccatcttccatcatcttataagcaattggcgcctgtctttgcagatcaggttcatcgacatacgcaaagtggaaatggtctttttcgtttgaagggaaaagagtgcgcggaatacgttccgcaagcggcggcagccaagggcttggcagcttctcgattcccatttcatcttggatgcgttcaatttcgtcaactacagcttcgatttcggtttgaacgtcttttttcgcgttatcttcggtatcaacctcagaaagcgggatcagacccgtatctgtaacaatcgcgatttcatcctcagtaccgtagacttcctctaagtaaggcgccccgctccatgcagattggaacagctcatacacttcattgtttccgacctgcaaatagccgcggcctgttacggtaatgtttgcggcatcgctgtttttcaaaatttctttactgtcggtggcatcctggaccttgagcgctactttaaagcgcgagttactccagatctggtcgtcgatgatgccgcctggcttctgtgtcgccaaaatcaaatgaacgccgaggcttcgtccgatacgcgcggcactgacaagctccctgataaaatcaggctcctcgcttttcagctcggcaaactcatcagagattaagaacaagtgaggcatcgccacttctgctttcccttgcttgtacagctttgtatagtcattgatgtgattgacttgatactggtcaaacaggcgctgcctttttttcagctcgcttttaatggaagcaagcgcacgcatactgaagtttttgcttccttcaatatttgtgatcgtgccgaggaggtggggaatgttgcggaacggctgcgccattcctccgcctttatagtcaattagtaagaaagccgcttcatgcggatgaaaatgcactgcaagtgacaagatgtaggtctggagaaattcacttttccctgatcccgttgtccccgcaagcaagccgtgcggaccgtgtgctttttcgtgaaggttcagatacacaatgtcatctttccctttatagccgatcggcactgacagcgacttcgacgattcacttgtcagccatctttgctgaatgccgatttcttttacttccttcgcatgaaaaagctccaggaacgataccgtttccggaatggaattcgtaatgccgacctggtggttcagcgtccgcagtgtgcgtgaaaaccgttcgttgtcctcacgctgatgatgatcgagacggaacggaattcttaccgcttttttcttttgtattaaaatgtcgccttcatgctcattaatgtagcggacaagagtcgtaatgttttccgacaagctttcctttgtttccgcagcgacaattgtcgagatgcccagatgctcatgctgtccttctaaatattcgagaatgacatgctcagagatcagctgctgattcgtgatgacaaatacaaaatgcggtttgaactgcagtttttctttgtcatcttcgagatcacgctctctgatcaattcgtaaagtgaagacagaagctgatctcgggtttgctcattataaataaatccttttgcataaatatggggcatttgaaattgcggaagccacttcatccactcccagtctttatactcttcttcatgaaaaataaatacaaaacgcaaatcgtgatagctgttaaagaacgacagctgtccgatcagctggtgaatctcatttttcacaatttgcgatttaccgacaagccccatcggaccttctgccaaatcgaccgtcaccggcgcattgcggatatctttatagacgcgctgcatgtgctgcgatttctccatgaggtcatcgatatcacgattcgccaagtctccgccgctcatattgatttcatagcttgacggaactgttcccgtcccaagccgcagctggagataatccttgctttcaagtgatttttcccagatccggtcactgatttcacttgttaagtatttcatttgttcaaatgaaggaaagtgaaattcaagaacctgcttttgcttttcagcaagtgcctgaagctctttccgcttattgtctaagtaaagcttatatacacgcttccgtttttcctcgcgttttttccgctggtttttatcccggaaatattgcactgtcgaggtaatgagagtcatcataaacatcgccaaagaaacgagtataaatatgccgcgcggctggatgatggcaactacgcccatcacgatcagcatcacaagcggaggcaggatgacgagccacagccctctgttggtttgatcgctctcctgagagggaaaactgaaagaaacgcggtcatccggcagatcgtataccatccgcggcgttcttctgtactgcggatattttttctgcatctctgtactcggtttgaccgtttctgttaacgctgtttcaaactgggcataatgaacaatttctaaaaggtcttgttccgtcaccctcatttgcgtgaagttccagaatatttcatcccccggcttgagcggcgtattggcgttgattttctctccgttcaagaagatcgttccgctttcagggcggaccgaccagctgccgcctgcacgaagcaaagaaaacgtgctttgttctgcaaatgcaaaatcttgcggattcagataaatatctgcattcgttttttctgaggaacatacaatttcatcccgatttcccgtaaaataaacggatttctcaggttcactgcccgtcaatatcaagcgtatatcctgctgatccgtttggagagtaaatgatatatccgtctcaattgtgccgagacaatcatttcccaggaaaacttcgtattggccgccggattcctttcttttaagagaaaccacgccgctattaaatggaatggtgctgatcgtaacagaatccttcacatcaggccctatggtcaccggatgagacgacgggaggttagacagatttaatttttgaacgttattttggtaaaaaacccataatagactcaaatggcgaacccccttacggccgaatggcagcatgcgatgacctgcgcttcatgtctcacgttatttgtcatcttttttctcatctttcttttctgtttcttttttctcgtcttcttttttcttctgttcttcttttttcgctttttcctcggctgcggctttttcttctgccgctttctcttctgcttgtttttcttcgtctgtttgtgtctgttcttcgcttgtatcgactaacgatgtttcagaattagactgtttattttcttgacgttctttttgggctttttcaagctcactatttactgagtcaagttctttttgtatgtcttcatcatttgtatcctcagataaaagctgctgtttatatttagctagggcaaagtaaatataatcattgtattcaagcttacggccgatactgatcgcttctttgtattctcctcgaccataatcaatccaatataagaaatgctgagggtctgattgaagggtgactaaattattttctatatttttggtttttgcactccccaggttttcgacctcaacataggacgtcgccagctgatactgcaccgattcaggcaggctttccgcatcgtacttggacagtgtgctgatgacttcactgtactgcttgtttaagaacgcacggttgctgtccactatcgcctggtgctttggctgcgcgaaaaataaggcgtacatcgaataaataagtgccggtacaagcaaaacaatgagccccaggccgatatatcgctggatgttccacttctttctcgggatatgtatgtatgtttttgctttggcttcgagctcatcaatatgggtttgaatcagctcgagcaaatcatcataggattcagcatctaatatcgcctttgcctctgcggagaacgtcagcgtttcattgaatttcaggtagtcttcaaacgcaaaagcgccgtcaactgccaaagccgctgccgctttcagctcctgccatactctttcctcatcacgctcgtaaggaggaatgctttcttttactccataatggagaaaataaggcgtaagccctttatcgaatacaatgttttcaggagcgacaatcaaattcagcctcgacagattgtgctgctgtacggcttgaacaagctgataggcaaactgccatttactttttttatccttagctttcatgaagcggaatgctttataggaggagggaggttggattgtgatgattacttcatcatccgtcacatcgatttctttatgaaaaaatggatttatatctttgatcacattagcttcaagaccgtcgagaagctttattttttcccgttgaaaggtaaatgtatagccggcatctgttttctcggcaacagcttctaattggttttctaaatatgatttttgttcacctgacattcaaccagatcctttcataatatttcaagccggtctccgtttgtaatgccgcaatcagacagcttgcattctccggaaaacaccttatccttgttcaccactctgatccagtgcccttcgcgcggaggcatagatacgttttgggcctgccaagcaatatcaattacttttttcaccgggtggtaatctgacaatctgagatcaaagacactgccgttataatgtttcaaatctattgtaatatcaatatacatttaggatcacccttacatagaaagagcgccgtcttcttttgaatcaggcgctccttccctttcatactgttatccgcggatttgatttgcgatgtcttggtcagtagactcaagtgtatttgctgtttgatcaagctgctgattcacatcttgaagcaaatctgacattttgataaatgaaggtttgagctgctcgtattgatctgcgaacgcttcgcttgaagcaccttcccacatgcttttcaaatcagagatcattcggtttaaacgatcaacctgatttaatacttcttggctttcaacgccgtattgcttcgccatcgctcttagctcttcgggtgtgacacgaattaatcctgccatattcctcattacctcctgtgccatcagcctaaatatgggctaattcacttatttttagaacgtcattattataaaaacagtttttcggcatagtcaaacaaatatgttttaattttacaaaatgagtccaatggtttaccccgaatcacttaaaaatgacatataatgtaaagtaaataggtttattttcttaatcttctcttcattctccgaataatccaaaagacccaaataactctccaactcccaaaaaaaacctttcagaaaatttgatgctacagcaccatttctgaaaggttcagttttttctttccttaattagtcttgcctccgatgactttcttagaagattaataggataagctgtcgtattatatgaggcatacactgtcctgcaaaaaggcgattacaccgccaaatgtatatagaacgtttctctcttgaaattgtttttttgcttctgttctttgttgttgattttcacaaacaacaacaatcataataaaaggaaggggatgagatgtcaaagagaaatcaagcacgaaaagtagggagatttatgaccatgccgaatgatccgtttaaatatagttttgacagacttgaagatgtggctgatcatatcagcgacgttctgcggtgcccgatcaccatagaggatgttaaccacaagctgcttgcctacagtacacacagcgactgcacagaccctgcccggacgtctaccattattggcagaagggtaccggagaaggtgattaacaagttgtggaaagatgggacaattccagctctcttaaaaacggaccagccgatcagagtcaagcaaattgatgaagtcgggctgagcaatcgcgtcgctatttcgatttggaaaaacaatcaagtgcttggcttcatatgggcgcttgagatccaaaaaacattgtccgatgaagatctgctgacattgcaaatggcagcaaaagcagtgaaaaacaagcttctcaaacttcaaatcagaaaaacgaaaaatgaagaacgcagccaagaatttttctggaaaatgctgaccggacacatccatcaggaggatgatatggcggatgggttccataagcttggaatggccgctccttcagagttttccgttatgatcatccgcataaatggtgagctgactgaaaaaatcgaacagcagctgcaatatttacaggaaacgacccagcaggtttacgtgctgctggcgaccgtagattccaatgaacttattatattaacctcacccaaaacagatcatccttttcaagatttaaaacagtttgctttaagtacgcaaaaacagctgaaggagcggtataaaatagaagacgtttctatcgcttttggcggaatatacaactctatttcttttgtctcccgctcctatcaggaagcattgtccgtcttaaaaacgaaggaacggttcactgaagagaccaaacatcttttcagcttttctgagttaggcatttatcaatacttagatgtcttatatgaaaaacggaaacaggcgggccattataattactcgctttccaaactggaacaatatgaccgggatcaccagtcaaatctggtagagacgctagagcgctttattgaagcggacagcaacgtgaataccgcttccaagctgttaaatatacacgttaatacgttgaattaccgactcaagcggatcagccagatcgctgaaattgatttgaaaaatgtgaatcaaaaattcaccatctatttagatatcaaacttcggcacatggatttgtgaaatttcacaaatccatgtttttttattttcttaatcaaacaaagaattttccaaaatatcaagctacactaaaaatatcacaggatacaggaggagacagatatgatcataggggttcctaaagagataaaaaacaatgaaaaccgtgtcgcattaacacccgggggcgtttctcagctcatttcaaacggtcaccgggtgctggttgaaacaggcgcgggccttggaagcggatttgaaaatgaagcctatgagtcagcaggagcggaaatcattgctgatccgaaacaggtctgggacgccgaaatggtcatgaaggtaaaagaaccgctgccggaagaatatgtttatttccgcaaaggacttgtgctgtttacgtaccttcatttagcagctgagcctgagcttgcacaggccttgaaggataaaggagtaactgccatcgcatatgaaacggtcagtgaaggccggacattgcctcttctcacgccaatgtcagaggttgcgggcagaatggcagcgcaaatcggcgctcaattcttagaaaagcctaaaggcggaaaaggcattctgcttgccggggtgcctggcgtttcccgcggaaaagtaacaattattggaggaggcgttgtcggcacaaacgcggccaaaatggctgtcggactcggtgcagatgtgacgatcattgacttaaacgcagaccgcttgcgccagcttgatgacatcttcggccatcagattaaaacgttaatttctaatccggtcaatattgctgatgctgtggcggaagcggatctcctcatttgcgcggtattaattccgggtgctaaagctccgactcttgtcactgaggaaatggtaaaacaaatgaaacccggttcagtcattgttgatgtagcgatcgaccaaggcggcatcgtcgaaactgtcgaccatatcacaacacatgatcagccaacatatgaaaaacacggggttgtgcattatgctgtagcgaacatgccaggcgcagtccctcgtacatcaacaatcgccctgactaacgttactgttccatacgcgctgcaaatcgcgaacaaaggggcagtgaaagcgctcacagacaatgcggcactgagagcgggtttaaacaccgctaacggacacgtgacctatgaagctgtagcaagagatctaggctatgagtatattcctgccgagaaagctttacaggatgaatcatctgtggcgggtgcttaattcacaatgagcttgcagaaaaatttctgcaggcttttttattttttaaaaggaaaaaagagaccatttcacgaattatgactatgaagttgatcataaaggaggattcatatggctgttcagcaatatggcgtgttaaaaggcatagtcttagacatgaagcgggaaacagatgatgacagtcctcatttccaagtcaaaatgcttggtgaagagaatacgtattacaggtgcgccatcaatgtgatgtccagttctgaggaatctgaagtattgtatttggctgacgatcagtttgattcgggctcaattaccatccttccgaacatgccgtatggatatacaaggatcaatgaagcaaaccgtgaagtggcactggattatgtgcggggcaatttgtttgacccgcgggaaatgaagcctttgcctcatgaaatcacgggacctgataatgatttaaatgattttattgaaacctatatgaagaaagcacaagatgagaaagcgccggtttatatattcggttcaaaattcggccctgaacaggctgcagataaaatattcggctttaccccgactaacggaatgcacaatatccatatgaatcaagggaatgcaatggatacgcgctggaaaaaagacaacggctcttggcatgacgggggtattctgattcagtttgcagatcagtgggccgctgtgtttttagcgtttttatcccaatcttggtgtaccgatgaaaacggaaacccggtcagagattgtgatcatacccaaacgtctgcgtaagattagaaaaagagactgcggcgagcagtctctttttgatacgattacacattttcaacagtctttaggctgtttggcctcatatcgctccaatgcgattggatatagtccaaacaagcttcacgccctttttgctcatgaacgactgtccagccgctcggcacatctataaaaccgggccatagggaatattggccttcttcattgatcagcaccaaatatgtgccatccgcattttcaaaaggatttgccattctatttctcctcccttatttattcaactcttccagtttgacagcgagaaccttgccgatttgagccagaggttccggctgacataaatctttatgacggcagtcgatgtcgatttgttcaatctgtccgctaatataaggcttccaagagtcaggttcaatcgggtcaaaccattcaggaatgattgttgatctgaaaaacaaaacatttccatggaaggttttcggcttataggaacctaaaatgccgacagaattgacatacgtattcttcaaatttaaaatgaccgtttcatccaggctcgcaagcgcactgccgtcacggcgaagaatctcaatcgccgcttcaaaatctagcggtttgtcccctaagctgtctggatcgtacccgcctaacgccagaagggcaataagcgcttcctcatcatccggcgcctcttttataggaaggaagtggtttggataggcatccagcatcaccaatagggaaacttcttctccttgattttgcagctgggtagccatcgcttgaacgacattcccgcccagggaccagcccagcagatggtacgggccttttggctggaccgttcggatttgtttaatgtaatcggcagccatgtcatcaagtgttttcggaagctcctcgcgctgcccgattccccgtgcctgcaagccgtagatcggataatctgttcctatattggtcatcaaaccggcataacaccagctgagcccccctgccggatgaacacagaataaaggaggcttgtctccacttgttcggagcggcagcagaacgtcaagagcgctttggcttgatcccatttcaagtctttcagcgagcccggctactgtaggtgcttcgaacaagttgccgatgctgagttcaacgccgagcgcttcacgaatgcggctcatgagctgtacagcaagcaaggaatgtccgcctaaatcaaagaaacggtcatcaatgccgacacgcggcaagtgaagcacctccataaagaggtcacagagaatttcttcctgcggcgttctcggtcctcgccctgtcactgccgctgcgaaatccggagcgggcagtgctttacgatcaagctttccattcggtgtcagcggcaattctttcatcgtcacaaaggcagcaggcaccatgtaatccggcagtctctccgcagcatatttgcgcagttccgccgtatcaaatgtttcttccgaagggatgacataagctgccaaccgtttatctcccggctgatcctcacgaacgatcactgccacatcttcaagctgcggatgctgaacaagcgcggcttcaatttctcccaattcaatccggaatccccgaattttcacttgatggtctgcacggcctacatagtcgagagaaccgtcagcgcggaggcgggccacatccccagtgcggtacatccgagtgcctggaggaccgaacggatcagctatgaagcgttcagatgttaaaccaggccggcctagataacctcgtgctaaccccgctcctgatacatacagctctccggcaacacccggcggaaccggctgcaggcgttcatccagcacgtatacaccaagatcgggaatgccgcagccgatcaagctgtttgcccgtaaagctgccatgcttcggtctaattcgatatagctcacatgcaccgtcgtttctgtaataccatacatattgataagctgcggtctattttcagggtggcggttataccaatcctctaaacggctgagttcaagcgcttctccgccaaaaatgacatagcgcagactgagtgcctgtccgagatccggctgttcccgttccgcctgcataaactgatagaaagcagacggtgtctggttcagaacagtcaccccctctttgacaagcaggcgcagaaacgcttctggcgatctgctgacgtggtgaggcacaatcacaagacgtccgccatgcagcagaggaccccagatctcccacaccgaaaaatcaaacgcataggaatggaacatggtccagatatcatctgagctgaaacggaaccagtgctcggtcgctgcaaataaacgtgttacattttggtgaggaatcatcacaccttttggaacacctgttgagccggatgtataaatgacatatgccgtattcaaaggcgaaagcggctgagtcctatccttatttttgggattacctgcagggtacgtgtttagtttctctgccagctcgggatcatccagcacgattttcggcacgttttcaactggcggaatgtgatttgcagctttagtgttcgtcatgataaacgcaggctgtgcatcttttagcataaaagcaattcgatcagccggataatccggatcaagagggagataagctgccccggcttttagcaccgccaataggccgacagccatttccaacgatcggggcagtgccaatgccacaaattgctccggcccgacaccttcactaattaggaatcgggcaagccgatttgctctttcattcagctctgcatagctcagtgcctgatcttcatatacaacggcaatagcatcaggacgtaaagcagcctgcttctcaaactgctctggcaaacttgcgtgcggaatcttttcagatacactttgccaatctgtcaccatgctgctgcgttcctctggcgcaagaatatccagatttccgatttgctcgtcaggatcagactcggcagcctccaacagccgcatcaaacggtcagcaagagcctgagcagtttcccgcttgaaaagatcagtgctgtattcaagcagtccttccattccgtttggtgtcccgtcagcaaggcgatcttcactgatttccagcgtcaaatcaaacttggcagaaccgacactgttgattcgcaggctactctccatatcaggaagatgcaattcagcgtccggtgtgttttggaacgcaagcatgatttggaataaaggatgcgtcgcacgcgaacgagccggattgagcacctctacaagtctctcaaacggcagatcctgattgtcataggcggccagattcacttcccgtactctgtctagaagctcacgaaagcttgggtcaccggacgtatcagttctgagcaccaatgtattaatgaacagccctacaagatcgcccagcgcatcatcattccgtcccgcgatcggactgccgatcggaatgtcggtgcccgccccgagccttgtcaataaagcggcgagaccggattgaagcaccataaacaggctcaccctatttgcgcgagccagctcctgcaatcgcttatgaagctcgggctcaatacgaaaatgaatcgtatctccatcatgactcggctcagccggacgtgaataatcggttggcagctcaagctgatcaggcaggtttttcaaggtttctttccagaaagcaagctgtccggcaatcaagctatttggatcatcctcgtttccaagcagttcttgctgccaaagcgcatagtctgcatactgcacagcaagaggcgcccattctggagatcgtccgtggcagcgagccgcataagccgtcccaaggtctcgggtcagcggtgttaaggaccagccgtccccgacaatatgatggacgagaagaagcagcacgtactcgtcaggaccgatcacaaaaagctcggcacgaaaagcaggttcagctgcaagatcaaagctgtagcgtacagcttcggcaagccgatcagaaagctccttctcagcaatttcagtaacatgtaactcgggacaggcttgatcagcatctaaaatatgctgatatgatgtcccctgtgattcagggaagattgtccgaaggctttcatgacggcagacgaggtcataaagtgccgctttcagcaatccttgatccaactcacctgacaaacggacagcaaccggaatattataagtaggactcggtccttccagacaatgcaggaaccatagccggcgctgggcaaatgagagcgggatcttttcaggccgctcagctctctgcaaagcgggacgtgcactctgcgccaaatcaagatgggcagcgagtccggctactgttggttcgtcaaagagcttggcgataccaagttcggctcccattacctcgcgaatgcggctcatcagacgggctgcaagaagagaatggcccccaagctcgaagaaactgtcatcgataccgacgcgtgccaaaccgagaacctctgcaaacaagtcacacaatatctcttcctgaggagtccgcggggcccgatcactgacagatgtgctgaagtctggtgccggcagtgcattccggtcaagcttgccattaggtgttaatggcagcttgtccatctccacaaacgccgccggtaccatataatcaggaagactagcccccatataacgacgaagctctgcagtatcaatagcagcatcagcgactacataagccgccaatcgtttgtctcccggctgatcttcccgtacgacaaccgcggcctgttcaatgtgcgggtgattggcaagcacggcatcaatttctccaagttcaattcggaatccgcgaattttgatttgatgatccgcccgcccgatataatccaaagacccatcggcgcaccagcgggcctggtctccggtccgatacatccgagttcccggcggtccgtatggatctgcaacgaagcgctccgccgttaaatcagggcgatggaaataacctctggccaagccggtgcctgcaatataaagctctccgacaacgcccggcggcaccggctgcaatccattatcaagcacatacacctgcgtgttccaaatcggtttcccaatcggaggaacgcccttcagcccttcttcaagaaaagctgcggcagaccaaatcgttgtttcagtgggaccgtataagttcgtgactgaacaatgaaggtcttgaagcgcctgcaaaagaccgctcggcagcgcctcgcctcctacaagcactctaagcccccgaagtttctcaggttcactcgttaccaaagcgtgccacagtgtcggtgtcgcctgcatgatgttaatatcgaaattttcaatcatttgagctaatgcctgcggctcacggatcgtttctttctttgcgatcacaatttgcgctccgctaatcagcggaagatataactccaatgctgaaatatcaaaagcgacagtcgtcacagccaacagcctgtcttcttctcctagagaaaacgcctccttcatggacagcagaaaattgcttaagcttttctgtgtcacaacgactcccttcggtcttcctgttgatcctgaggtatagatgatatacgcaggatggtcaagagaaaccgatacatccggattttccggcgaatagcgttttataatctcctgtgtaacagcctgatcaagcacaagctccggtacagccaggttatcaggcagactggctgctatttcctcagtcgttatgatgcatgaaggtttcgcatcctccagcatgtaagaaatgcggtccgctggaaactccggatcaagtgggagatacgccgcaccagtcttgagcacaccaagcattgaggccaccatctcaggggaacgcggcagcgccaaagcgacaaattgctccggaccaatccctttttcgatcaacagacgcgcgagacggtttgcctcttcattgagctttcgatagttgacttgaatgtcatcacacatgagagcgatacgttctggcgtaagaactgcctgcttttcgaacatgtcctgaaggctgaccagcttctctgattttgccgtctcattccatttagaaatgactttttctttctcctctggcaacagaagctccatttgcccaatcagcatgtcctctccggcagaagccgtttgcagcagctgcaggatacgctgctgatgaagcttaatatcagactcactgtatacctcgggattcgcatcaacatcaattcgcagcccgctgccgtctgttctgtcatatacattgattgatagatcatcaacaggaccggctgaaagattatgcgttgtgccccgggcgccggcaaagtcgagaccgtaatcaaacggcataagattgatttgagggccaaataatctatgattttctcctatcaatttcagatcgcgccgaagctcttcatggcgatacttatgatgtcgccgaatgctgcggatttcccgggaaatttgctgaatcagttcagaaaagctcatcgaagagcttaccgtcagccggagcgggagaaggttcatcaccatagccggtacattcagtgacgcggaccctatccgacccatcatgggcaggccgagcacaacatcctcagagccggtcatacggtgcacataaacagctgacaccgcaatcatgacttcatgccagcttcctgagaaatagcgcgccgcttcttttaacgcgtttacatcagacggaggcagatatgccgtatgacgaagaaaactgttagatgttcttggcgcccgatcagccaagctcacaacttcaggtgcatctgcaaaacggtccagccagaattgacgatccttctcatactgctctgatccgcgataatctgtatcctcctccaaaatggcctggagagacccaaaggaacggcttttagctgtttgtccttttataagcgcagtatatgtacttgccacacgctgggctatcagggaaaaaccgaagccgtcgatcgctatatggtgaatgcgctgataccaaaagaaacgatcaggcccggcaataaacagagcttcattgaacaaaggggcataccctaaatcaaccggctttgctaaatcagctttcatccagtttaatgctgttttttccggatcaggctcagagctgacgtcaatgacgtgcagctgtacatccggagacgggtttatcatctgccaaggcccgtccatattttcaccgaagcggacatgcagcgattccgcttccttgatcacgtgccgcaaagcttcttcaaaaagagcaatattgattggtccattgatttctatatattccgctgtattgtagattggattgtccggatcaagctgctgagcaaaccatatgccagtttgcgccccggtcaaagaatattgaagatcttttgtatcaggcatccgtttgtttaccctccttttataaataatccgcgtttggcagcacttgctggctgcgggttgtgagcaatttccgccattcttcgatcgttgggcgttcagccaattccacgaaagtcacctctgccccttcacggcgccattgttccaccaatgtcatgatccttaccgaatcaagaccacgatcgagcaaatcctcttgatctgtgatgtcttccggtgtttcttgtagaagctcagcaatttgtttacggatattctcacatgtaaacacgttctttttgccagtgtttgctgacgttttttgaacgtctgccggcgcattctgcagctgatcaagaagactgtcagtcatcacggtaaacgcacagcgtccagccgcatattccagcgccatttgatgtttttctaatgaaaaatcagcaactgcatctcccacaaaaaaggctttaatatcctccataaatgcttcacatgctgtaacaagacagccgatatgggcgtaaattcctgtaatgatcagctgatcgcgtccctctttgcgcatcatttcaagcagattcgttctcttaaacgcgctgtatctccattttgtcagcacaagatcatcatcctctggtgccagctcggttataattttctcctcataaggaccgctgtttaatcccgggccccaaaagtctgtcagcagcgcacggtcatccggattttggcttcccggctgtgcggtatagacaacaggaatcccaagctgaacacattgattcttcagctttcgtatattcgctgaaagctctgttaccggagacgctcccgctgtgaaagcatcgacaaaatagttttgcatatcgtgtattaacaagacagcccgatttggatcaggcacccatgagactttgttttgcggcatatcagatgctgtcggcatttgatacggctgaatggcaggtatagccatatgaacacttcctctcaaattgttgatttattttttgaccctgcaagaagtttctcggaaatggcttcacgaagagcctttttgcttacctttcctacccctgtctgcggaaaggattcgacaaattcaactcggtcagggattttatatgccgccagtccgcgctctctcaaaaatgctttaagctctgcggcttttggggcttcatctcggggaataatgaacacacaagatctctcgccaagaaattgatcaggcatggagaccattgccgcatcatggacagccggatgcgccagcagatgattttccacctcttcagccgcaaccttttctcctccacggttaatttgatccttcgcccggccttcaacgacaatatacccgtctcgtgtcagcctgacgatatcacccgtacggtaaaaaccgtcctcagtaaatgaagcggcgttatgctcttctgccttatagtaacctcgaattgtatacggtccccgcgtcagcaaatggcctgtttcaccaggttttacgtcgcgatcatgatcatcccaaacacgcacttcatcatatggggacatcggttttccttgggtgttgacaatgatctcctcaggatcatccaatctcgtataattgacgagaccctctgccattccgaacacctgctgcagcgtgcagccgaaaacagcttttaccctgcgcgcggcttcagcactaaacttggcaccgccgacctgcaacacttgaaggctggataaatcgtcacggcgtgaggatgccgcatccatccataccatcgcaagaggcggaacaagagcggttatcgtgaccttttcccgttcaattaaaggaaatgcgtcatctggacttggagaaggagataataccactcttcctccagcgtataatacgccgagaacgccaggtgagctcagcggataattgtgtgccatcggcagcgcggccaagtacaccgtgctgtggtcgagccagcagacctccacactccgcttcaggctgtatatgtagtcatcgtgggtcctcggaatcagtttcgatagcccggtgctcccgccagaaagctggaggaacgccacatccgaagatttgacttcaggcagttttacaggttctgtatgcaaatcctcgagcggcaaaaattcctctgcctcacctgcgacaatgatgtttttcaaagtcggcagcttgctttgaacctgtctggcaagcgaacggtagtcaaaaccggaatatgcgtcgggaatgatatatgcagccgcttcagcaaactcgcaaaaatatgtaatttcactgcttcgatgagaaggcagtgcgaagactggaagcgcccccagacggaaaagcgcgaaaatgacttcaaaaaactctttgatatttggcagctgcaccacaacacgatccttctgttgaatgccgagcttctgaaatccggcagccaggcgatcagcccttgtgtccagctctcgatagctccaatgggtgtttccgcatgtaatggcaatgcgatcaccatatttggctgcccggtctcttaacaaatctccaaacgtctcgccggcccagcagccattctttcgataggtctcagctaactcatcaggccaaggcgtaaatcctttcagcatgttgcatccctccagcaattcattctgttcatatgtgatccacgcccattgcccgcagcattgtccgaaactttgcggacgtctcctgaagctcgtcctcgggctttgaaccggccacaacaccagctccagcatacaggcggagtgagcgttcttctgcttctgcacaacggatggtcacgatccattctccgtcaccggcatcgtcacaccatccgaccatgccggtaaagaaaccgcggtcaaatggttcaatgctgagaatcgcttctcttgcaagatcagtcggtgttccgcagactgctggcgtcgggtggagagccgccgccaattcaagtgcggttacagacgggtcggaaagctctcccttaatcacgctggacaggtgccacatcgtttccgttttgatcagtgaaggcttctccggaacctccagcgtccggcagaaaggtctcagcgctgccgcaaccgcgtcagcgacaaccgcgtgctcatgaagatcctttgcggaagaaagcaattcagctgcccggcgctggtcttcaacaggatcattactgcgcggccttgagccggctaatgggttggaaacgacctgtgttcccatccttgaaacgaggagctccggacttgctccgagcaatgttcggcggggagacgtttccccctgactggacacgtctgccgcaaacgtgtagccatgcgagttatgctgagccagatggcgaagcaattcatccgtctgaatcggttcaggcgatgtcaaatgcagcgatctggacaggacgattttgctgagtgttccatcggcaatgcgtgtcagcccttgttcaacaccatttttataatcctcaggttcaggaacaggctttatgtggtatgtatgcccagcctgctgttccttttcctcatgatcaaattgaagcggtcctgaccagcgcacttcttcaggtacaacgagccgcgctgcttttacttgatcaaaaggaacggccccgacaacaagcggccggctttgccctgattgttttgcctgacgtaacgcctctgcaattcggccagaaagggtttccatttggttttgcccgtctgcctccggtacgatttcacatatgcctttcgctaacagtacacgatgaggagacgctaagaaaaaggcgcccggctgatattcatgaagcaaatgctccgcttttgtttctgttataacgttttgatccaacattctcatgaacctcctttaaattcagttacacgcctaaggtcgcgccgccatctacgcataaattatgcatcgtaatatgccctgcctggccagaaaccaaaaagagcaccgcatccgcaatatccgaaggcttggctagttttttgagcgggatccctgttttaaatgtctcaagtgatccttttatgacttgctccgctccattctcgtcggcccataatgaccactgcatgtctgtttccgttgatccgggagatacaatgttgcagcgaatattgtattctgcaagctcaaggccaaggcatttcgtaaacatcacagccgcagcctttgaagacgcatatgccgccatagatgttcttggtacaccggcagcattcgatccgactgttacaatcgaacccgatcttcggtccatcatatatttgctgactgaacgcgaggcgttaaatacgccagtcgaattcactgagaacgtcgcctcccattcctcatcgctaagcgaatggatcagtcccgggcgaaggacacccgctacattcactaaaatatcaatcggccccatttcacgttcgatgcgcgccgtgatctcatcaatcgctgcgctgtctctcacatccgcaggaaaagcttctgcatggcggccttctgctttgaggctgctcacaaccttttccagcttttcaggattataatcaactgccgcaatatgtgcgccttgactggcaagcgtccgcgcaacagcttcgcctattccttgggcagcccctgttataaaagcaatttttccctctatactctttgcattcatatcatcaattcctttcttcgctctaaatgccgaacagacatccagcgcaaaagactgctgcgccttgaaaaacgcaatctattgataatgattatcattatcaattataaaaataatcatatccaaatgtcatgtgacagtcaaatataatttcagtgacaaatattttttaaaggcaaggctgagtatgtctcagcccattgaaagatgcggtccgtcagggtgaagcgcaaaacgcagcgcccggctgaccaaaacaggaagaactgaaatatgtccttctcctgaaaactcgcaaaattccgcccgtatgccttgttcagataaaacggccagccgctcataaagctccctcgcattgtcgttcatccggcttttatgatgctgctccaattctcctgcggcaagcaggatattgataggctgattgtttgtcttggtgagagagacgaaatggtccgttttctcgagaataaacggtttattccaatgaatggacggacttcccgcgatatacgtttgaaacgcatcgggctttgttagcagcacctgcagcacgaaaagccctccgagcgaatggccaaagattgtttgtctttttttatcaatctggtaatctcgttctatctccggttttaaatcctcttcaataaatctgaaaaagccctccgctccgccatgctccggccattctctgccgtcgggcctttccggcagcttcgattgggctgttggcattgtaaaatcccggtggcgtgctgaggagaacggctccgctgtctcatagccaatgccgacgatcactgcagggatcaccccggttttttcgggtcggcgtccctgtattcgaacggcttccgtcatcgttccgaagacagaattggcatccagcagataaatcacaggataaccagcgggtggcggtggcgtactaggtttcgagataaaaatgtgataggtacggttttcattgcgtgaagacatcatacgcacttccgtaccaggaatcgtaaatgcgtttgatgtcccgccatttgtccggtctgttgtttgctctttcatgcagtacgacattcctctccttaaactaaaccgcaatgtatgataatgattttcactatcaactagacacctcaaataataggttttcttccaaagaaagtcaactttttcccgaataaaaaaggcaccttgatcaaataaggtacctgcagactatcaatatggaagtaaaaacccaataaagatgcggattgtcctatttgaaatagaaccttaatcccatgtaaacctttgattttgccaaggatcgcctctcatgtgatagccattccgctcccaaaagccaggatgattttctttcgtaaattggatgccgcgcagccacttggcgcttttccaaaaatacagatgcggaaatacaccccgcagcggaaagccgtgttcaggggttaaaggttcgccattatgcgcataagccagaagggaagtttccgctaagaaatcatcaagcggcagattggtcgtccagccctcttcagcatgtaaaatgacgtagcccgcttcttcttttacacccgctttttccgctatatcacaagcccgcacgccttgccacacattatcaagccttgaccatcccgtgacgcaatgaatgtcatttttcgattcataccgtggaaaggctttgacatcttcaaagcttagcagcatcggatggtcaaccaaaccgtatacttgaagattccatttcgtcatatcttcgtaatatgggacatctccggtatgaagcacaggaaatgaagtggtgacgttttgatttggcggcactcttccagattgatcggattgtcttgtttttccgaaatacatatgggcctcctttttgttaacctaatttaaaatcatgttgacaatctttttgttctttattactctatgattgtgtatgtcaacctaagggggaacaacgatgaaacaacgtaaacttcgtgcgggagatatggcgctgattggcatgttcgccgcacttatggctgtcggggccaacattacatcagtagcaccctttttacaagtagccggcattccgctttcgatgcagccgtttttctgtctcttggctgctttgcttcttggcagcaaacgagcagcgattgccatgattgtatatgcacttgtcggattggccggagcgcctgtgtttgctcaattttcagcaggcttcgcaccgtttgcagggaaaagcggcgggtttattatctcatacatcccggcagcatttgcagcgggttggtttttagaacgaaacattcagccaagtaaaattcgatttctcattgcttcacttatcggaacggcgatcatgtatctcatcggcactacctatatgtatcttgcactgaagctgtggattcatacgccagtgagctacggcacggcttggggctttatgatttggtttatggtaaaagatacagcgctggctgtgatactgtcgtttatcgcaccagcaatctaccgctctattcataaagcaaccggctttaacagaaatcacatatcatctacgtaaaaaccgttctattggacggatttttatcataacgagaaaaggctccccagtaaaggggagcctttttcctataaaacaagcgctgcaatccagccaaagatgacaagcggaatattataaaatataaatgtcggcacacaagtatcccaaatgtggtgatgctggccgtccgcactcaaacctgaagtcggcccaagcgtactatcactggcaggtgaaccggcatcgccaagcgcagcagcagccccgataatcgcaatcgttgccatcgggctgaatccaagctgcatgcatagaggcacgaaaatggttgtaataacaggaatcgtcgcaaaagaagatccgattcccattgtaattaataagccgacaatgagcatcagcaatgcgcccaaggactgactatgtccgataaaaccggctgacgttttgaccagtgactcgacatctccggttttcgttaatacgtttgaaaacccggctgcaacaagcatgacaaagccgataaaggccattaaaaccattccatcagtaatcagtgagtccgcttcatcacgcttcatcacaccgctgacaaacagaacaatcagaccagcgagcgcccccataatcattccttctactcccaaagtctgagataagtaaagctggacgccgagtgacacaacaatggctagaaccgcgataccaatgctttttctcgtatatggcgatgcttctgcacctgaaatgtcttttgtttcatattgtttcggtttacggtatacgatcactgataaaataaggccgacaaccatacctgcaactggaataatcagtgcgtacggaatatcagcaagcggaacgtttaacccagcatccgccatattgtccttcagcatgccttggaagatttggccgaaaccgaccggaagcaaaatataaggagccgttaagccaaatgtaattacacacgcgatcagacggcggtccatttcaagttcattaaagattttcaaaagcggcggaatcagcaccggaataaacgcgatgtgaaccggaacgacgttttgcgaaaaacaagatacaattaaaataatcagcacaatcagcaccttagacagtgctttttttcgagaatcttctttatttccgattaatttaacggaggcttccaccattgcgtccggaagacccgttttcgtcaaagcggcggcaaacgcgccaagcatggcatagctaactgcaacggtggcatttccgccgagaccgtctgtgaaagctttaaccgtttcgccaagaccgagcccgcctgttaacccgccggccaaggcgcctataattaatgcgataacaatattgacacgcagcaggcttaatacaagcataagcaggactgcgatgacgactgcattcatgatgatacccctccaaaaatcctttagtttgctaatgtagtagataaataaagcacgaacgtatcgtatcataaccgatccactttagtcaactaaagatttcggaagaaaaaatccctgccgcatcatacagcagggatttttcattactcgtttttatcttcttccaatgtaaatcgctccgcaagtgtagccagtgttcttgccataacgccagtagccccggccggcccgaagcaggttgctttatttgcagtcgctgttcctgcaatatcaaggtgaacccaaggtgttgactcagcgaattcaccaagaaacgttcctgccataatcgcatgtccctcgcgtcccggtgaattgttgagatccgccatttggctgcttttcacgcgttttttatccttctctgttatcggcagctgccagattgcctcgccggactcttgtgcagcatcagctacctgctggtaaaagctttgatcatttgtcattgcaccggttgtttctgttcctaatgccacaacgacgccgccggtaagcgtagctacatcgacaagaactgacgcgccatgctgtttcgcgtatgtaatgccatctgcaagcactagccttccttcagcatccgtattaaggatttctattgtttttccgcttaaagatacgatcacgtcatccggcttcatggccccgccggaaatcatattatcggttgatggaataacgcacagcacgttttgctcaggacgaagctctccgatcgtttccatagcaccgagaaccgcagctgctcctcccatatctgatttcatgccgacaattccagatttcgttttaatggagtagccgcctgtgtcaaaggtaattcctttcccgactagtccgacgacgtcctcccattcctttttgccctgatatttcaacacaatcattttcggcggttcggtggagccttggtttaccgcaagtattccgcccataccgagctcttccatctctgatttctccaatatctcacactcaaaatcatatttcgccgcaagctcttcagcatacgaagcgaggtcagtcgctgtcagcatgtttcccggcatattcacaagcgttctagccgaatttgtcccttgtccgtatgcctggccgacgcgaagccccgcctgcacttcctgtgtatcttcatctgttacaacatacacggcttcaatttgtttgtcaggctcatttgatttgtgcttataatcctgcacctcataggaagcaagcaggcagctctcagctaaagcatgcgcggcatcggctggaggcacgtcttccgaaataaacgtatcaagcagaacagcagtttcttgttttcgatctttatgaatggcttgaaaaacatgagcaaaacgttccttcgcctgttcaaacgaataatttgcttctctccccagaccaacgaaataaatccgtttcatacccgcagaagatggagggaatacttttgatacttgattcggtttcgcagagacatcgccctcttttaaaagctgtgtcagatggccttcgagcatttcatcaatttccaacgcttttcctgtcagctggcttttttgaaaaagcccgaccacaagggtttctgtatgctctgattgttgaacagcataaaacatgaggcttacactcctaacgtaatgggtatttgtaatgaacaatggtataataggaaaaacattctttccactatacttattttaacaaacaacagtctaagacttgcttttttcttttgaaacacgaaggatttttcaaatagaaaggatgtcgccgatggaacttttaacgaattttcctttattatcaagcctggccgcaattatttttgctcaggtcatcaaagtgcccatacagtttatcgtgtccagaaaactggactggtcgctggtcacaagcacaggcggcatgcccagctctcactccgcagcggtcactgcactttcaacaggcgtagccttggagcatggattagactcctcactctttgcggtttccgccattttcgccgtcataaccatgtttgacgcaactggcgtcagacgtcacgccggtgagcaggcaacagtcattaataagcttgtcattgattttaaccgtttcgtaaatgaagcgaaggacttccctaaggcagcagagaaagaaaagcaaaaaaagctgaaagagcttctcggacatcagccgatcgaagtctttttcggaggactaacaggtattttactgacattggtactcgcttactttttcatgtaaaaaaacgctcctgctttcgctggagcgttttattctttcacagttttatattgatttctgaacacttgcaaagattttgtttcattgagcttctcaagctcatcctcggtaatctttcccgttccctttttaatcacatatacatcaagggtttttttgccccattcattgtatacatctttgacggtttcaaagtacagatcaaggcggtttcccttaattgccgatcctgtgtcagctacaacgccgagaccgtagttcggaatgaataagatcgtgccaatcggaaatacggacgggtcagcagcaaccgtggaatataaatcccgtttcactttcacacctgaatatgtaagcccgtataatggatcaccaggatttttgcccgtcgactcagctcctgctgtgtagcctgttgctgttactctttggactggatattcattccaatcaaatgcctcttctaacggttttgttttatcctcagccgcggacgtggtttgtgtttgtttctgctgcaatgcttttaatgtcagtcctgcatgcttcaagtgcttttcctgatgttcctgcacccattttgacaagtccttcgcttcaattcctgacactgataaaaatgtcgtgccaaatgcaagcagaaataaacaggtcatcagcaaacgtctgatcatattcaacatcattcacctctcctccgaatcattgttcccaagtggagagagcattattcaaaatggtgaatgagctgaacgcataaaaaaagctttctttagaagaaagcggcatttaaaacatttgatatcctctttttctaagcatgttgatcgctataccggacacgatggcgccggccaaaccgctgactaaaatcagcacatcagcagccgctaatgataagacacgatgaaacaggctggcaaaggattctcccggcgactggacatagctgatcagcttttctttgctgataatgaaaaggcatacaattggataaatcacagccataatccaagacattctcagcagcatgtttaataagaaaccgattccaaaaaacaagacaaaaaacaaaacaattgagatgattacgactggcagactaatcaacctattccacccccctgcgttgtttttagtgtaacgcgggggctgaaataaagtcaacggctggaaaaagaatgactgtcttttcctgtcccctggcaagacggacaagtctctgaaccgccgagaatcaattgaaaatatcctttccctgaacaaaatgggcatgcatgtgaagcggttgtcgttgcagttttcatctaatcatcaccctttttcttaattttctgataatataccatatcaagctgtcaacaataaagtcagatcatgtgacaaatcttttgatgtaagcggaaacatacttgttttcctctcgttctctttttattttggcgttttttaataaagaaaacccgcttccgcgggtttttagaaaaacttgaacttgccttttttcaatgtcagtccgagtccgccaatcataaacagtgagcggttatcaatgacttttttcataaacgaagcgggcgtgcctttcagctttctgccataaacaaccccaaccgcgttatgctcgccaagagaagccactgttcccttaatgtccggcttgaattcctcaagctctccgcctttaataagcctgccaaggtttttagcgaccgttatgccctgctgcattgcaatttgcgcagtcggcggatacgggcgctctgtatcttcattcataaacagcgagctgtcgccgagaataaagacattgtcatgtcccggggcgcggagatcagggttgactttgactcggccgcgcatattctcaaaaccggcttcctccacaatcggatggccgcggacacctgccgcccatacaacggtttgcgatttgatctgctctggttcttcatcttttttgccgactctgactccttctggtgtacattcttgtacagccgttccgatcttgaactcaactccgttttcctcaagataatgtacggcgtaatcaacaagttccggatcaaagcccggtaaaacggtcggcgctgcttccacacaaatgatgcggacaaggcttctgtcaacgtcatattccttacagagctccggcacgcgagcagccagttcgccaagaaattcaattcccgtaaatccggcaccgccaacaacgatcgttaacctgtccggccgtttttccgcttccgtattgtaagtcgcaaactgcagctcaatatgttcccgcagcaggcgcgacgtgttgatgttggcaatcggaaacgcatattcttttaagcctttaatgccgaacgtttcaggcacggcgccgagcccgatgactaaataatcgtactgcagttctccattcgcaagcacaacttttttctcatcaattttgattgcctttacggtatcctgtacaaaattcacccgtgactggttgattacatcttttatctgataacggcagcggtcatgatggagcgtacccgcgctcgcttcatgcatccatgtcgtttcataatgataattgtgtttatttacaagcgtaatgtcagcatcatttggcccgacatacttcgtcagccttgtcaccgtcatcaatccgccatatcctgcacctaaaatcacgattttgggcttattcaatgccatcacatccaccttctctttttttgcttttgttagacccataataaaatcatcatttgtgttagcttcagcttattggcgggattttatgaaatatattgaaaagttttttgtgaagtccttacccgtagcactattatcatgtttatccggctggcccaagaaacattcagaaaaagatcatttcatttggttattatcgtagcggcctgcggaaatattttcaagaacggatgggcacgttagatccttacgattttttctgctgactcgtcaatttgaacggcaatatggtataattaataacaattttcatttaggaggcaattttcgtatgcgagaggatacaaaggtttatgatattacaattataggcgggggaccggtcggcttattcaccgctttttacggcgggatgagacaggcaagcgtcaaaattatcgaaagcctgcctcagctcggcggacagcttagcgccctataccctgagaagtatatatatgatgtagcgggattcccgaaaatccgcgcgcaagagcttatcaataacctaaaagagcaaatggcgaaattcgaccaaaccatttgtctggagcaagcggttgaatctgttgagaaacaagcagacggcgtatttaagcttgtaacaaatgaagaaacccactactctaaaacggtcatcatcactgcaggaaacggcgcattcaaaccgagaaagctggaacttgaaaatgccgagcagtatgaaggcaaaaacctccattacttcgttgatgatctgcaaaaattcaccggcagacgcgttgcaatccttggcggtggagattccgcggttgactgggcgcttatgcttgagccaatcgcaaaagaagtatcgatcattcaccgccgcgacaagttccgtgcgcacgagcacagtgtggaaaaccttcatgcgtcgaaggttaatgttctgacaccattcgtccctgcggagctgatcggcgaagacaaaatcgaacagcttgtgcttgaagaagtgaaaggcgaccgcaaagagattttagaaattgatgacttaatcgtcaactacggtttcgtttcatctcttggaccgatcaaaaactggggtctggacatcgagaaaaattccattgtcgtgaaatcaacaatggaaacaaatatcgaaggcttctttgcagcaggtgacatttgtacatacgaaggaaaagtcaacctgattgccagcggcttcggtgaagcaccgacagcagtgaacaacgccaaggcttacatggacccgaaagcccgagtacagcctcttcactcaacaagtctttttgaaaataaataataaaaaaagggagcttgtgtctgcgacacagctccttttttatttgaagatatttatataattcaatgcagttcctacaaccagcgcaatcacaagggctgcgactacccagatcattgccataataatgcggtcttgaatcttttgggacttcggtgttttttcttcgttttgggccattttattcgctcctttcccatgtccatgccataaagaaagcctggtgctgaacgaccaagctttgctgaacgtatatcattcgcgttttgatccgctctctaagaccattcgttaaaactatgatacctaaactcaccctgcatgacaagcttcggcacttgcaccactcctgccagcaaatcataatgtttgacatcctaaataaaacagagtacattatagaaggcgaacatttcatatattatacttttaaatattcgtttttaggagtgaaaaccatggaaaacgtatttgattacgaagatattcagctaattcctgcaaaatgcattgtaaatagccgttcagaatgtgatacatccgtacgtttaggcggacgtacatttaaattacccgtcgtccctgccaatatgcaaacgattatagatgaggagctagcgattcaattagccgaaaatggctacttttatgtgatgcaccgatttgagcctgagacacgaattgattttattaaagatatgaacgcacgcggcttattctcttctatcagtgtgggcgtcaaagatgaggagtatgaatttgtccgccagctggcagaagaaaatctgactcctgaatacgtgacaattgacattgctcacgggcactcaaatgctgtcattgaaatgatccagcaccttaaaaaacatttgccggacagctttgttattgctggcaacgtcggaacgccggaagcggtcagagagcttgaaaatgcgggagcggatgccactaaagtcggcatcggaccgggaaaagtatgtattacgaaaatcaaaaccggcttcggcacaggcggctggcaattagcggcgctgcgctggtgtgccaaagcagccagcaaaccgattatcgcggatggcggcatccgcacccatggcgacatcgcaaaatcaatccgattcggcgcaacgatggtcatgatcggttcactatttgccggacacgaagaatcgccaggccaaacgatcgaaaaagacggaaagctttacaaggagtacttcggctcagcctctgaattccaaaaaggcgaaaagaaaaatgtcgaaggcaaaaaaatgcacgtggcgcataaaggctcaatcaaggatacactgattgaaatggagcaggatcttcaatcttctatttcttatgcaggcggaacaaagcttgacgccatccgcaatgtggattatgtaattgtgaagaattccatttttaatggggataaatattaatcataaaaaaacgccaagtcagcggcgacgcttgacttggcgttttctgctacttcttcagcaaaatatgcttatattcgctttttgaatgtatctgtcatcagttctgccatttgttttgcatttggattttcttcattttgcaactgttcaataatgttcatataatccgtttcatttcggttctggcttaatttatatgccgcttgaatgtcttccaccttaatcttaaatccaacgatacctttcaattcacgttctaagagttttggagaaagcttatcccataaaacaggattgtcacgatgtttttcgtatttctccagcatgattgttaattcttctgctaattcatctttctctaacatacttgcttttccatacatgtggacagcctgataattccacgtcggaacattttcgcgcgaataccaggaagaagaaatataagcgtgcggtccctgaaacatcacaagcacatcttcacaggcttcaaacgttctccactgaggatttccataagcgaaatgccccgtaatatagtaatgatcatcttttttattgaatcctaacggcaaatgtgtggcaattggttttccttgttctgttgtgacaaccgtaccaaaggagttttcttgtacaaaattccaaatttcttcagcatttgtgactttaaaatattttggaatatacatcatcatccacccttcgaaaaatattatatgagtgttttagccatgattaaatccgtttgttcttcatcacccatataaaaagagtgggcgccggtctgaacaaaccccattttcttataaaaggcaatggcattttcatttttttcccacacacctagccaaatgttcgttttattacgttccagcgcaatttctatcgctttattcagcagatgtttgccaagcccatgtttttgaaagctgttctttatataaattctctcgatttcaagtgattcagcacccatttcttcagactgagcatcatcgatattgacctttacatatccagcgatttcatgatcaaagtaaacaaaaaagaattgcgaagacatattggataactctttttccagctgctcagtgttaaatgcgctttctaaataggctttcatattttcaggtgagttctgttctttaaaagtgtcattgaatgtttcaatactcaattgttgaagtgtttgtaaatcttcccggctgcattttttcatttttacactcattgttcggattcagcccctttatttaaaattcaattgtcttgtgtcccttttttaatatatttaaacacggaacagatactgaccttgttaccattccaaaaatcttcttcatcatcaactccctatcgtgattttgttgcaaatgcaataaaatatacccgcattaaatatagcgtaactttgctgtatttacaacaaaaatcaaacaacaaagcagcgtttctcttgccgaagtccccggaactctctgcatcatttccccataataaaaacgcctcccttaacgatgatttatcgctaagaaaagcgtcagtaatagttgctatccgtttttagtgcttagcactcttcaggcttgcctgcattcgttgctgttctgaacgaagaaccgcagccgcatgaagcgatggcgtttggattgtcgatggtgaagccgccgccgagcatggattgtttataatcaatcacggtgccgttcatgatgtcaaggctttctttgtcaactagaacagtgatgccgtgctgatcaaacacactgtctgattcactcttttcatgctcaaagcccatgccgtaagaaagtccgctgcagccgccgcctttgacgcctacacgcagaaacgcgttttcttcttcatgctctttcatcatatcttttatatgcaaagctgctgcttctgtaattgttaccgggttgctcatcattgtgaacctccttttaaaaaccggttgctgtcttttattataaacatgatcgttccaattctcaaacaaggtgttttacaagaaatagacaccctcacaaacggtttcagccggccctgtcatcattacatggccgttatctttccagtttatcaccaaatccccgcctgctaaatgcaccgtgatgtcttgatttcgctttgatacgccgtttaatacagatgcgactgccgctgcacatgctcctgtcccgcatgcctgagtaatccctgatccccgttcccagacgcggaaatgcaattcttgttcattcacggtttcaacgaattccacattgatgccttccggaaatctcggatctttctcaatcaccggccccagtgtcgttaagggtgcctgttcaatgtctgcgatcggaaaaacgatatgcggatttcccattgaaacggcagtgcctgttagttctacttcaccaaatgccatcgtttcattgattgtgtgctcttccccgccgtcaagcatcgggagctcggattttgtcaagcgcggttcgcccatatcgacagtgaccacattcacttttccgttttcgacttgaacctccgctttcacaagcccggagagagtttcaatcagaaaagatgtttcctcaaccagcttatgctcatatgcgtattttgcgacgcagcgcaggccgttgccgcagtttttcccttcagatccgtcattattaaaaatccgcattttaacaggcgcttggtctgatgggcatatcaggatcattccgtcggatccgatccctgtataaacagaagaaacctgaattgcaatctctgacagtttttcttctggaagctgttcttcaaattgattcacataaatataactgtttcccaggccgtgcattttggtaaatcgaaatgagttcataggtgcctccaactttttttctttttcttagtataaaagctattataagcggacacaatacaattatcccccgtttttcatacataaaagctccttgcactgacgcaaggagcttttatcgtttatataaacatgccggcaatagctgcgcttagcagattggctaatgttcctgcaagaacagccttcaggccgagacgcgcgatatctgaacggcggctgggtgctaatccgcccagcgtaccaagcataatcgcaattgatgaaaaattggcgaatccgcataacgcgaaactgataatggtagcagttttcttagaaaactcgccgatgtgcggaccgaagttagaataagcgacaaactcattcagcaccaatttctggccgatatagcttcccgcctgcaatgcttcatgccaaggcacgccaatcaaaaaggcgataggagaaaacacatagccgagaatggattctaatgttacgccttttaaaccgaacaagccgaaagccccgccgagaataccgtttactacagcgattaacgcaacaaacgcaagcagcatcgccccaacatttaacgcaatttgcagtcctgttgacgctccctttgcagctgcgtcaatgacattggctgcgccttcgccttcatccattttgaaatcgctttttacggtttgcgttttttccgtttcgggtataatcaatttaccaaagactagtccagctggagcagccataaagctggccgccagcaagtactcaatcggaataccgagaagcgcgtacccaaacaaggtagatcccgcaactgccgatagaccgctcgtcataatcgtaaacaactcagagcgcgtcagcccggcaatcaggggtttgatcactaacggagattctgattgtcctacaaaaatattggcagcagccgccagagattccgttttgcttgttccaaggagcttcgacaatccgccgccaatgacacggaaaacgagctgcatgattttcaaatgatataaaactgcaatcagtgctgagaagaaaatgataacgggcagtacacttaatgcaaatgccggactgtctccgacctttagaagcggtccaaaaataaaactgatgccttcattcgcatagtcaatcagaagctgtacacggcttgaaaaccataaaaaaacagcgcgtcccgcttcccatttcaacacgatgtatccaaacgccacctgtgtgcataaaccaacgatgacggttcttatcttaatattgcttttcttttctgaaaataaaaacgcgatagcaatgatcgcaactgcgcccagcagcccccacagaacattcatgaatactcgtacacctcttaaattttatttaaaaaaatatcttttatacgataacaataatattttttgatgtctacacatttttttagttcttttgtacgacaaaataaaaaagggcctgtccaggccctcttctttaaaacattggattttcttcaataaaggtatatatattctcaacaagctcagcaggcgtttcacccatgacgacttctccgtttaccagagcgaaaagcgattccatgcatgtcccgcagtagcttaagcagccatattcaaggacatcaaggttgggatccttctccaaaatcgcccgggcttcctgagagccgtgagccagattgctgacacaaaattcaatcattggattcatgcggtttcacctcacatatgtccattatcgcgaatttttcactattcgtcaaagacaacggatgattcaaaatttattatcgtaacatattatttctcaaataacgttttactaatttgtgttttcaggctaaattgtaggttattttgaaactattattgtgattttagatcaaattcgatataattctagatgttattttacatagttcgtattttcttcaatgtgtctatcatactcttcggattaaaggggaattcaaatgaaaaaattggtcttgatcggcggaggttacgggaacatgcgcgttcttcatcgcttattgccaaaccagctgcctgatgatgtttcaatcacgttaattgacagaaatccttatcactgcttgaaaacagaatattatgcccttgccgcaggcacaatttctgaccatcatatcagagtgtcattcccagagcaccctcgcctggatgtccaatacggtgatatcacatcaattgatattgtacaaaaacaagtgctgttccaagatcgtgaaccgatttcttacgatgacgccgtaatcgggctcggctgtgaggataaatatcacaacgtgccgggagcgcctgaattcacctacagtattcaaaccatcgatcagtcccgcgaaacctaccaaaagctgaataatctgagcgctaatgccaccgtcgccattgtcggagcgggcttaagcggcgttgagcttgcaagtgaattgagagaaagccgtgatgacctgaacattattttgttcgaccgcggtaatctcattttatcaagctttcccgagcgtttaagcaaatatgtgcaaaaatggttcgaagagcacggtgtccgcattattaacagggcaaatatcacaaaagtagaagaaggcgttgtgtataaccacgatgatccgatttctgcagacgccatcgtgtggacagccggcatccagccaaacaaagtcgtcagagacttagatgtggagaaggacgcacaagggcgtattgtattaacgcctcatcataatcttccaggtgatgaacatctgtacgttgtcggcgattgcgccagccttcctcatgcaccgagcgcccagctggcagaggctcaagcagagcagattgtccaaatcttgcaaaaacgctggaatggagaagccctgcctgaatcaatgccgcagtttaagctgaaaggcgtcctcggttcactcggaaaaaaagccggcttcgggcttgttgctgaccgtccgctgatcggccgtgttccgcgtatgctgaaatccggcttgctgtggatgtataaacaccataacggttaatgatagagaagaaccgctgatcaagtcagcggttttctgtatacccatgcttctccatttcctcataaacgtcttttaattttggattgccttcaccgacaattttgtcttctacaagcacaagcggataaaaatactcgtcatttctgattttttccgcaagctctttcgcatgttcattgtcaggcggctcatgaatatcgatgtactgcatctcaaaaggctgatttggatattttcttttcagcgcagcctcaagccactcgtatgtatccttggctgtcggcatatttacacagctcgcacaaacgttttctgccccgtacacgcttagcatgactggtttcatcacttgtagacgcccccttctcctatgtaagtcctttcttttaagtatacagagcctaagggcgtttttatagaaaaaaaccgtttttgtgttgaagtctgaatgtgctataatagggaaagcaactttgcaaaccaaacaatagatttttattgttacactgaatataatggttttatgacgacgaaaggagcgaatgtcatgactgaagttgaaatgaaagaacaggtgcaggaagtactggacaaacttcgtccgtttttacttcgtgacggcggtgactgtgagcttgtagacgtagatgaaggtatcgttaagcttcgtcttctaggcgcatgcggcagctgcccaagttcaacaattacgctgaaagccggaattgagcgcgctcttcttgaagaagtgccgggtgtcgttgaagtagaacaagtcttttaataaagcagccaggctgatatttgatcagcctggcttttttattagagatagttgtcaaaccatgagctgatataattcaggcgcttgatccgctgtcttgggtgtccggtgcgtgataaattgtgcgatgcattcggaaaacggacaagcttggtttccttgcccatttttttcagagcgataaacagctgctccgcctgctcgatcgggcatcggtcatcccgctcgccatgcagaatcaaaagcggtgtctccacgtttgctgcgtattttaaaggagaccggtcccagagcttttctgtgtcctcaaacatgtcatgctcaagctgccagtctgtaaagaaatagccgatatcactgacgccgtgaaagctgatccagtttgaaatcgagcgctgggtgacggcagctttaaagcggttcgtctgcccgacgatccagttggtcataaaacctccgtagcttccgcccgtgacaccgagccgcttaggatcaatatgcggatctcgcttgatagcctcatccacagcttgcatcacatcgtcataatcctttcccccataatcccctctgaccgcattcacaaattcctgcccgtagccgtggcttcctctcggattgatataaacgaccgcgtatcctttcgccgccagcacctgaaactcatgaaaatatgtatgtccgtacatcatatgcggaccgccgtgtatgttgagaataagtggatatgttgtctcaccttccatttgtgcaggcttcatcagccagccgttcaccgtcacgccgtcttctgtagcatattgaatctcttcaggtattgatatcatatgctcactgacaaacttgtcattcgcgccagtcagctgtttctcttcctgtccaagcgggatactgtaaagctcactcggtctgtccggctttgtcacactggcaataaagtgctgttcatcaggtgaaagagaaaagctattgatgtactctttttccaggcgaactggatacacaaggccttcaatcgaaatataatagatgcccgtactgccttgatctgtgccgatgacataaaacccttggctgtcctttgtccaaatcgggcgctgttcagcaccaccgatcaatgaatctccaatcagcgcatccgctaaatgaacgtccagcatctcagtaagacatgtgaggcggccttgttcgatatcatagagccacgcctttgagagcgtagcattcttatattccttttcatttccaagcaaagcaagataccttccgtctggtgaaaatgagcttgatccgaatgagccgcgatgaggtgtaacctgcttaagatctccagactccagtgacattatgtaaacatcatgcggcttgctggcatcatctgtttcagttaaattagctgagaaaacaagccatttgccgtcaggagaaaaagcaggatcaccatgatcagctttgtgacttgtcagctctttcatctcacccgactttacgctgacaagcacaagctgggcatacgcacctctcgtcagccctttgccgtcccgtttgtaggagaggccttgcacttcaacaggttcatagctgtcctgctctgttttttctcggtcatcaatgttttctccctctcccaaactgacagtgaccagaatcgattcgccatccggggaccatattggctttgacacgccatacgggatatcagtcagttttctcgcttctccgccttcagcgctcatcatatacagctgtgccgcatcgccttctcgatcagaaataaaggcaagcgtgcacccgtccggagaccatcttgggtcggtgcttcgcttttctccatgtgtccaaggaacagacccgcccgttttcgtttcatagatccatatatttgatgtatacgaatctttctcttgattcacttgtgattttacatatgcggcacgggtgccgtctggggcgtattgaggatcggtcacagagacaatcgctgtgatgtcgtctgcggttatcagctttttcatattcatctcctcctttttacatgtatttcgtttttctaaataaaaactcctttatctccagcaaaaaaagcgccctctgctgacgctgagaacgcttggcatgatctatacactttttacttgatataaaggatttcgctctattatacttccctctttcggaacggtcaaagcgtctacttcacaatgagggaaatgaagcgcgagctgttcttttagctcttctccctttcctttttcggtcatgacgagaatcgtcgggcctgctccgctgagagccgttccatatgctcccttcatctcggcgacgtgctctacttttgacagctcaggcacaagcatcgcccggtacggctgatggaacatatccttcttcatgattttcccgacgagcggccaatccttggacatgatcgcagcaatgagaatattgctgacagcacttgcttttacggcgtcggcatatggaaactccttcggaagcacgtctctcgcgtctcttgtcagcacttcgtaaaaaggaatgacaacgactacgtcaatgtcagcattcgggacgcggatcatttgggtctcgtcatcctcatgcaggccgatcacaagtccgccgacgagagaagcgccagcattgtccgggtgtccttcttctagactggctaaatgcagcttgtccgcttcagacagctttaagccgcataattcatcagccagttcaatagccgctacaatcgccgcggcgctgctgccaaggccgcgtgcaagcgggatgtcgctccacaccttcacatggacaggaggcatttcttttccgtacaaatctgcggtccgtttagccacttgatagatcaggttatctgtacccgccggaattccggcgactgtttctgtttcagcctcaaaagaccatttgtcgctttcaaagacggtcagcttcaaatatctgctgagcgccattccgactgaatcaaagccggggcctaggttagctgtgcttccgggaacagtgacagagaacagcatgtcggcttcgttcatacacgggccgctccttttacatattcaaggatgctgtcttcatcagtcggcaatgtgacaggcttgatttctgaaatgtcgaccgctgtgttcggatctttcagtccgtttcctgttaacacagctacgaccttgctgcctttcggaatttctccggatttcacctgtttcagcactcctgcgatagacgcgcaagaacccggttctgcaaacacgccttctacacgggcgatcagctgatatgcgtgaaggatttcatcatcagtgacttcgtcaattttcccattggattcctcggctgcctttacagctttgtcccagcttgccgggtttccgatacgaatggctgtcgctattgtttcaggattttcaatcacttcattgcgcacgattgccgccgcaccctcagcttcaaagccgcgcattttcggaaggcctgtgccgtttttctcatgatattccttgaagcccttccagtacgcagtgatgtttcccgcgtttccgaccgggatcgctaaaacatcaggcgcttcccccagctgttcgcacacttcgaaggcagcagttttttggccttcaatgcggtaagggttgactgagttgacaagggcaatcggtgatttctcacagatggaacggacaattttaagcgcatcgtcaaagtttccgtcaattgcgataatctcggctccgtacatgacagcttgagcgagttttccaaatgcaatttttccgttcgggatgatgacaatgcatttcatgttagcacgggctgcatatgctgccgcagcagcggaagtgttacctgttgacgcgcacataatcgtgtcattgccttcttcttttgcctttgccacagccataaccattccgcgatctttaaatgatcccgtaggattgacgccttccgttttgacatgaagctcaattccgagctgctcagacagcttcggcaggtgaataagaggtgtgtttccttcatgtaaagttagcgccggtgtttgatctgttacaggtaaaaattctttatattgatggataagtcctttccacattagctccaaccgttcccttctacacgatatgtgcttttgacttcttgaacgacttccaaatcatttaggttttgcaggatatcactgaaatcagcttctgatgtatgatgtgtgacaattacgatttcagctaactcatcatggcctttaattggcagctgaaggattttttcaaagctcacgccccgctctgagaacacagatgtaattttcgagaatgaaccaacctcatcttttacatgaattcttaaaaactgctgtgcataaatgtcagacggcgatttcatgtttttctcatattgcggtccgacaaagctgttgccggttacaccgaggcgcatatttttcatgacagcgacgaggtcagaaacaacggatgtcgctgtcggcatgcttccggctcccggcccgtagaacatcgtctcaccgacagcctcgccgtatacataaacagcgttaaactcattatgaacagcagaaagcggatggtggtcaggaagcagtgtcggctgtacgctgacctcgattttgctgccgtcacgctgagcaatcccgatcagcttcattgtatagccgaggcgtttgctgaagctgatgtcctcgtctgtaatttgggagatcccctttactttgacgtcttccagatccacgttcatcgagaagccgaggcgcgccaatatcgccattttccgtgcggcgtcaagcccttccacatcagaagtcggatcagcttcggcaaaaccgagatcctgcgcttccttgagcacttcctcgtatgggcttttctctttgatcattttggttaagataaagtttgttgtgccgttcacaattcccatcatttttgtaattcgatctgatgagaggccttcctctaacgtgcgcagaatcggaatcccgccggcaacactggcttcaaagtagatatcgcatccattttccttcgcttcagcaagcagctcggagccgtacacagccattaagtccttgtttgctgtgacaacatgctttttcgatctcagcgcgtcgaccaaatattgttttgtctgttcaacgccgccgatcacctcgatgacgacatcaacatctggatcatcaatgacatcatacacttctgtcgtgagcacttccttcggcaaatctacttctctctttttctctaaatcttttacaagcactttttttatcgtaaccggacagccgacctgatgcataagcttatcctgatggtcttgaataattttaacgacaccgcttccgacggtacctaaacctaaaagccctacacgaatcgctttcaaaaaaactccacctttcttttgattgtcctcttggaaaagacaattgttaactcaacacagacatataagttacaaacattatataagcccgctcctgttttgacaagacagcattaggctgaattttgcgaatgtaaacgcttaacgcattgatatgacaagattctttattttctaattatttttgtcagattttctcctcaccttgagctgcctttgccgagccagctgacgcgtggaacaaacagcttctgcgcccgcatattcatgaattcctgcgctgtattgagaaattgttcataacgcccacagtcattaagaatgaagtcaagctgttcttcaaaataatgcttttctgattctgatgacatgtaatagctttctacgatttcaaaataatgaagcgggaaaagcagacggctgtataaaaggcgtttcgaaaatgaagacagcggtgtgacttgctcgtattcctgtaaaaagagaaagccctgctgattaaaatcttgtctgtgatgcaaaaacgtatgcctcatatattcagccaaatcacgggaagcgtggtcaaacacccaatccgccggaatcctgatcaatgattccggtgaccatgtatgcctttccatccgctgatggcatatcgttcctgaatcagcggcttggggcttgtcatccagctcagtgtccactaaatattgtatcgcgttttctgacagtcctaaataatatggaaatgattcgatcatttttttatcgaatggctcatgcggaggggtctgaacctttctctgccaaaatgcttccagctgatcaattcgttttccccacagatccttccactggccgattcttccggccgccttcacctcatatggatatcctcggccttttcggtgaaattccgcaagctccgctccaatggagaacgccctgtttgaataagggggggccgccttcagcagagcgtacgtttttccctcatgttcaaatgtcagttcaccttcttttgtaaagataaaaaccgaaacgtatgggtcactttgttcttgtaaatactgactcatgtaataaagctccgccagctctgtttctgagaattgggaaacggggacaatcagaaagtatgaattaggcgtctgaaagcattgatatgtgtgctggtacatggaaagctgcctgatgtgaatgccgtatttttcttttattgtacctttcaccatgatcacctgcctgttgaattagggctcatcacatcgtagtcatacacagccggaattatgaatacatattttaatccgaagaaggcgcaagaaaaagtcgtaaacttctcaagcattttgtataaactagtaaaaaagattgggtgaagctgatgtcagaaaacgaacaattcagtcagatggaagctaaagcaagagcacggatgaaggagcgcggcgttgaggtatcagacattgccgagcttgtcttttttctgcagaaaaaatatcatccggatttaaccattgatgaatgcacgctgaacgtcaatcgtgttctcgcaaaacgcgaggtgcaaaacgcgattttaacgggcattgaattggatgttcttgctgagcagaaaaaactgtctgaaccgctgcaaacgatgctggaaatagatgaaagcctatatggagtagatgaagttctggcattttccattgtgaacatttacggatcgatcgggtttacgaactacggttacatcgacaaagaaaaacccggaatccttaaacgattgaatgataaatcaaccggtgaatgccatacctttttagatgacatcgtcggagcgatttccgccgcggcttcaagcagacttgctcaccgcgcgcggcatacagaataagggcacccttttagggcgcccttttttcaaatgtatggaatccattcagtcagagagtcaatggcgtgagtcggtttttccatatcgtctgttatatgttctcttttcgttacgcctgtgtgaacgagcagcgtatccatacccgcgttaatgccggccataatatcagtggcgtagttgtcgccgaccatgagtgtttcagacacatctgtgccgagaacgcgcatcgcctgctccataataattgattccggcttgccgataaatacaggctgtacacctgtagatacggttaacaccgatgtcagtgagccgtttcccggcagaagccctctttcagtcggaatcgcaatatctccgttagtggaaataaagcgggcgccatttctgattgccaggcagccgacagcaaatttttcgtatgtaatggaacggtcgatgccaacaacgacaaagtccgcgttttctccgccaaatgtcaggccgttttcttcaatcgcctggcggattccttcctccccaatcacatacacagacgcgttttttttctgctgggcaatgtgctgggcagttgccatgctggtcgtgaagacctgctcttctgttgccggaatatcaaaagacacgagcttgtccgctacctgcttcggtgtacgcgaagagttgtttgtcacgaaaagataaggaacgccgcgatctttcagcgttctgacaaattcacacgcttcctcgattttttccgtgccattgtacatcgttccgtctaaatcaattaaataccctttatatgttttcatatccaacactcctgtggctttccagttgttatttaaacgcagaaacaggtcctagctctgtttccaaatagcttctgatccgtttcgggaagtcctgaagagctgtttgatgcgccttgatcagcctgtaaagctcgccgctgtcagcgagcagatactgttgaaccaacgttttacggtaggcgatcaatttcttgagctcagcaccctctttttccgtgacaactttctcatcaacaagtatatccataatgtcgtcatagctgcccgggtcccgcataataaagccgtcaatcatatcattgcctgtatccaaaatgcattcgattaacagatggcctatacgctgaagtgccaattccccgatttcagattgccagtctgtttgtgagtcaaatagcgccagctggtgctcgaagaaccctagtgttttctcgattttgcttctgtcaacaaaatacatgacagcatcccctttgtgtatatttattttctgatccgtttcaagacaaaatacgcacagccgaaattgcagtattcgtaaatatattcatctaatgtgctgattttcgtttcgaaggttgctttttgattctggtcgtcaaagaagcccttgagccttaactgaccgtatccccagtctcccacaatataatcgtatttatttaatatatcggagtagcgggctttaaaagcctcttcgttgaagccgtctttgaaattgtgcaccaattcaaattcggcattttgaataagaatcatgatctcacctctttttcactcattcctatcataattcattgccccgtccccatcaattgctaaagaataaatcatgcgatttggctaccctacacatgaggagggattgataaatgaaacgaaccgctgtcagcctcttcctgctaaccggactattatccgggtgcggaggcgcaggattggataatgcccaaaatgtccggaatcagacgcagaatcaaaccaaacccattcatgtgtcggaccgcaacgaggcttttaacaggcataatgagaacgaacaatttggctatgtccgctatcaaagagaacaatttgacggagaccagcagaaaacgccggtgatgaaccgggaagaaaccgctcacatgatatcaagtttaacggttcagctcccccatattcaagatgctgcgacattggtgactgaccgagaagcgcttgtcgtatacaaaaccgattctaaaaaccgggagctgaccgccgatcaggtgaaaaaaacagcggcctccgtgataccgcgatactatcacgtgtatatttccgataatccaaaccatatgcaatccgtcgaaaattacagcaatctcggctctggttcaagggatatcagagagatcatgtcggggacgattcaagaaatgaaaacctccccgcaaggaagccctgtctcagagaatgaaaatgccaatggagaaacgcgtcaggacatgaaaatcgataggaatgacaaaaacgccagataatctggcgttttggcattatgcttgtgcttgacgctttttagatgcttcgtttacttgttcatccgcatggtaagaggaacggacaagcggaccggcttcacaatggctgaagcctttttgcatcgcgatttcttttaattctgcaaattcatcaggatggtagtatttttggactttcaagtgtttcttcgtcggctgcagatattggccgattgccataatatccacgttgttcgccaagaggtcgtccattacttcaataatctcttcttttgtttcgccgagcccgatcatgatacttgattttgtcggaatgtcaggctgcatttccttcgcacggcgcaaaaattccaatgaacggtcgtacgtcgcacgcgcacggactcttggcgtcaggcggcgaaccgtttcgatattgtgattcaggatgtctgggcgtgtatccattaaggtttttaggttatcgtagtttccgcccatatcagacggcagcacctcaattgttgtgaacgggctttttctgcggatcgcacggacagtttccgcgaaaatgcctgcccctccatctttctgatcgtcacgcgcaacagccgtaataaccgcgtgcttcagattcataagcgcgactgaatccgctacgcgttccggctcttgcaggtcaagctcagttggaaggcctgttttgacagcacagaaacggcatgctcttgtacaaacagaacctaaaatcataaatgtcgctgtacgtctgacagcccagcattcatgaatattcggacattttgcttcttcgcatacggtatgaaggttgttttcccgcatgagttttttgagccctgtatagttttcatttgtatttaatttaattttaagccattcgggctttctgaggtgttcgtctttctttgccaattcccatcatctccaatatccaatatactcaatttctgacacgaaacattctgaaaacgagaaaggtgcagattttagttctgcaacaaaaataatgtttttctaactaaagaaagtcttttctttagacactttaacataggaaaaatttctcgacaagggaagatgattactgacatttttaagccgggttgccgcaaactatgtgtattcaatatgaaaggagattattttgtgaaagttttgttatccgctcttcttctccttttgtttgcatttgagccttctgcgtctggaaaaaaactttcagatccagtgctgtcgaaacggatggaattatatcataaaatcgaagctgtgacgcagatcccttggtatgcgctcgccgctgttgatcaatacgaagaaaacgtgcggagcaaccggaaagatctgcctgaaaaggcgggaatcatcagcatctatatacccgatgatatctggagcgggcctgaaaacccgaatccgaaagacgatgcgccgttaagcattaaagtgtttgacggaatcggaatggatggcgatggagacgggaaagccgaggtcagcaacgatgaagatatcttgtatacgttcagccaatacttactgtcgtatggcacagatgaagacaacatccggatcgggctttggaattattaccggcgtgatcagacagtggggattatatctgaattcatgaagctgtttaaagcctacggccatattgatctgggcgagcatgcattcccgcttccgatcagaaccgattacagctaccgaagcacgtggggagatgcccgcggcttcggtggaaggcggattcatgaaggtacggatatctttgcccattacggccttcctgtcaaatccacatgttacggcgtagttgaaatgaagggctggaaccgcttcggaggatggagaatcggcatcagggacattaacaatacgtatcattattttgcccatctcaatgggtttgccaaagggattaaaacaggacaaatcgttgagcctggccaagtgatcggatcagtcggcagctccggatacggcccgccgggaaccgccgggaagttcccgccgcatttgcactatggcatgtacaaagataacggaagaaccgaatggtcatttgatccatacccgcatttgagggcgtgggagcgatatgaataccaaaaaaagaagtaacaaaaagccgcctcttcaacaggcggcttatttgctgcttttttctttttttgaatcggcaccgtcttctttgctgctcggaagctggacagaaggcgtgacacccgagccgccgcttccattataaaactgcggcacttcgccctgcactgctttaatcgatacaggaacattatttgtgacgacagcggttttgctggcaaatggaatgatgaccttcactttaatttcgacaaagatgctgatatcaataagtgcgttatttatgccatacggcttgattttggttttgacatctgtaaaagcgtcaccgattaaattgaaccggaccgggattttcggcccgaggtttccaagaaggctgttgccggttacctgtcccagcggaatgttgatcataatgttttcactggcgccgctgtgtccggtatgggtttccatctctttcaaatgagcctgaagctgctttgtcacttttgttttcacactgtttacaacctgtgtattaaaatcgattgtcgttaagtttccgttttcatcagaattcatttgaaacatatctttcatattttcactgtcagacatatagtcctcaatcgaatcctggatcacctctgtcgctatacgcttcgtttccatctcgccgatgtccattaaaacaggtttgatcgagccattgatcatccaaaggctgaccgttgttgacaggataaaaaagacaacggacaggagcatcacgtaacggaaaggcaaaggtcctctcttgcgaaaagggccgcgatatcttggcaagaaaatccccccttacatatcacaatgtatgcttgtaagaggggacatagtaatagccggggccaatttattttatttcaccatttttaaaagcgcttctctgccgctcatgccgactttgatgccaagatcttccgcagcgtacgtgacggattctaaaggtgcgtctaacagctggtcaatggtgcggacaccaactgcgcgtcccgccacaatgccgcgctcctttaatttttcattcagcagcgccacatccagcgcaccgcacataatatatccgtgatcattggcgacggccataaaattcgtttttggaagtttcactgtcacagctgtaaaaggctgtccttctatcatgatcggtgtcaggtttaccacgtcaaccactcccttcattcatcactttatgatgaagggcacagcttgttgtgggctgactgccttattgcgcaagcttccaagcaagcagatcccgcaaaaattccggcataaaatattctttttctgcagcgtcgcgaatcaacggaaacagtttgccgagcgtaaacatatcaagcaccgcaacggagtattgtttatgttttttaatatcttccccgttcagtgtgatccgggtgacgtgggtgatcccgtcatcgagccgtttcgtttctacctccacgccggcatacaccattttccccatcacttctccgcggaagccaagtcctttgatccggagctgctccatttgttcggaagcggcatggacaatggtttccttcaattcttctcccgtcaggcggacagccaccgggttgatcggatgcggacagatgcggtgcagatccagctttgtcacaggacctgcttttagcggaccgagaatgacacctgaattgaccatactgatgtccgtctcgcaccattcctttaaggcgtatgccaaaagcaaaggcagctctgattcttcaaaccacttcacctcagcatcttgtgcaagctctgcaacggcatcggacagtttctcctcggcttcacgttctttttcattgagaaacgcttttgtttctgcggattctcctgtccattccgccatgttctgcacagaagccgttttgctgatgatgctttgctgtacgctgtccaccgtgatttctacacagccgacataatgcccgtatttctcggcgctggccagcagtaccccattcaccacttgtccatcttcaagcaaatgatgggtatgtgattcgaggattacatcaatctcaggcaccgcttcagccactgcctgatcatcaagaatgcctaaatgtgacagcagaacgataatatcagcctgccctttcacttcccgaatggtttcctttatgctttcaagagcatccgttactgtccatcccagcttgtcatatacaggataatacggcacagttacacctaagaaagcaatggacataccgtttttcaatgatttgatatggtaaggcaccgcccaggacggacggtttccatttttatcaaacaggttagagacgatgacaggaaattcagcatgatcatataaggcagcaagctcttcatgcggaagcgtaatcccttcgttattgccgatcgccgctccatcaatgtgaaggcggtttaagagatcgacattcgcttttccgaatgtcgcctctgtcacgaattgaaaacgatcaagatgatcgccaatatcaaaaacgagcgtctcttcaccgtctgactgatgctcttttcttttctgctcgatataatctacaattttcggccaattttcaaaatggctgtgcaaatcatttgtatgatataagcggagcttctccttcataatatctctccctaatcgttcagctgaaaatgccttcataaatgagctggcagccgatcaaaatcaatacgatccgcatgatcataacgatcgttttcgtctgcatttttctgttgatggcggcgccaagctttccgccgaaccaagcgccgggcacaagcgcgagggcatacagccaattgacgtgcccggaaatcatatgtgaaacagaccctgtcatagaagacaggaaaataataaacatggacgttgccaccgcaaccttcggcggaaacagaaataacagcatcatcgccggaaccatcagtgatccgccgcctataccgaaaagtccgcctaaaaaaccgacaacaaaggcaatggcaatacccacagaggcctgatatgagtacgtataaggctcaccggcatcatcctgaaatgtccggataattcctttgtgcgctttgttgattggccgggctttcgctttcagcattaaggataatgaaatcagaatcataaaaatgccaaaccaaacggaaaacgagtttgaattgaacagctttgacacgtaagccccgatcatgctgccgggacctgaaccgataaagaaaatgagcccgctcttataatcaactgttttatatttaatataagccaaagttgaagaaaggcccgtaaaaataatgaccaaaagcgaagttccaatcgcaacctgcggcgtcacatcctgaaacagctgcgtcactgtgcttaaaaacatcagagatggcacaatgacaattccgccgccaagcccgatcagacttcctaccgtacctgcgattaatcccagtacgaccaaaatcacaaacgacatcaataaaaacctcttttctaaaataaatcgagctgtctcggagcaagtccgctgtactcgatatcaagcagttcaagcatctgcttgccattatccgcagcgtcaccgccggaattattgttgaacaggacaaaaacatccttacattgctgctgcaattcattcaggtgctttttccaatcctccagctcctgttggttgtagcggtataagtacctgacctcccgccagtttttcccgccatcaggcttcatccagccctgcttgttgcgtccgtgaaatctgacgagcgttttgttttcatcggtcgcgcgcaacacagtcggaacgctgccttctccgatttgcggttcatcacagacactgtgaatccagccttccgctttcataaatgaaagcgtctgctcataaaatggcggcgagaaccaggaacggtttctgaattcaagcgcgcaaggaatatctcccatttggtgcttgcaccatctcaaataggcgacattctccttcttgcagtcaaaccacggcggaaattgaaacagcaccatggcgagcttattgctatgtaaatatggcgttaaagacaccttaaacgcatcaaacatctcctcttttgagtcaaagggaatttcgccgcgctgatgccctgtcatgccctgatatgctttcacgataaattggaaggtttcgggcgtttccttcacccacttttcattattgcgcgccggctgaatcgcgtaaaagctcgcgtctaattccacgatcggaaaatgggaggaataggcctgcaattttttctggctggccgttttcggcggatagatgctgtcatgatccccccaccccgtcagtccgatataaatcacactcattcacctctcttccagtttatcacacgtgttttcaggtttcctcggaaatgctgttcatatggcgggaaaatgcagaacgaagatgctgatattgttcctcattcgtatctaaaaacgcctcttctcttgaggaaggaatatgctgatattcaataggcgcctgaaactgctcactcgtaaaatcgtacatcacaccattgatgctgttgtaaaaatgccagctctcaccgacttttgttttgaaaatcgtgccgccgaaatggtcttgaatcaccaatgccgtcacgccgcattggccgcatgacgggcattcttccgtccatttagagctcgaatggcgcgaccaggattgcttaagtatgtatttgacatgttccattgcctccgcctcctttttaaaaaagataccacgttgataagattttaaaaactagaacagaggaaatcaaaaaacccggcggtaaaatccgccgggcttacgaaggaacgaccagagctccgtctatttcaatgactttttccccatcattgtacacgcaccggcctttgctgtaagtggccgtaatgctgcagggaaatgtatgtccttcgtaaatgctttttttatgctttgcaaacatcgattctcttgtaacagtgtatggctccatgctgacgagcacgaaatctgcatcacaccccgcctcaagccgcccttttttctgaaggccgaatcgttttgcaggggccgccgctgtccattctgcgatggtttcaaacggaatctgatgctcaagcgccagttccagcattcctaataaagtgaactgcccgccgctgattccgccccatgataaaaacagattgtcctcccgctttaaggatggacggcaaggggaatggtctgaggaaaccatgtcaatgtctccggcaatgagcgcctcgatcagcgtctcttttgattgccgtggccggagcggaggcgcgcattttgcaacagagcccttttcacgtaaatcgtcatggctgaacaagacataatgcgggcatgtctcgaccgaaacatcaagaccttcctgtttcgcctctctgatcagccggaccgctttcgccgtgctgatatggacaaaatgaaccggacagcctgtcaccttcgcatactgaatcgtgcgatacaccgcttcaacttctgcttcctccgggcgggaggcggcgtacgcatccgcgtccacctttcctttattggccaaaaccatctgcaagtagcttgtgatcgcatcgctttccgcgtggagagcgaggatttttcctgcagccgcgatttctgccatgcctttgagcaatgtccgttcatcaacagagcggaactcatcagtgcctgactttgataaaaacgctttaaacccgatcgctcccgcttcagccatcggacggatgtcctcgatatggcctggcacaaggccgccccatagcgcaaaatccacggcagatttttgcctgcctagctcagcttttgcgagaagatgctctgccgtcacggttgatggaatacagttgagcggcatatcaaaataggtagtgcaaccgcctgcggccatcatttgagaacctgtttcaaacccctcccaatcctccctgcccggttcattaaaatgaacatggcaatctatcacaccaggaaacacgtatttcccgtctgcctggatgatttccgtcccgcttgcttcaatgtcagaacctatctcggcaatgacaccgttttgaactgcaatatcagcttctataacgccatctggcgtcactgccttcgcaccttttatcaccatatcgtaagccatattgatccccccatgtaaggatgacgatttttcatgtcagtttatgtaacacaaccagttctattttcaacagtttactgctactatgatcgtattacatcagcaaaaccgctagaattcctattgaaaattattcaccttaaccaatgtttttatagaaaaggagaatgcgctatgaatatttttgatgtgatgaaaataccggcttttgaaaacgccaatttaatcgctggaaaagcaggaggggaaagagaggttcagcatgtcaatatgatggacgctccggatatcgcagactttttgcataagaatgaattgctcgtcaccaccgcctatcacctgaaggatcacccgcatcaattatctgaactgattcggcaaatggcaaaacgcggctgcgcgggcctcggcattaaaacaaagcgctatctggaagatatcccgaaggaaatcatcgaactggccgattcatatgcgtttccgatcattgagcttccggaacacatccgactcggcgatattgtgaatgccacactcagccatattctcgatatgcgttctaacgagctgcagcaagccatttacgcgcacaaaaaattcacaaaccacattatgagcggcaaggggctgcaatccctcctcaaaaaggtgtcagacctccttcagcttcccgtgctgctgcttgaccagcatgccaaaatgctgtctgcgtctcatcagatttcagttgagaccgaaaagctgaaaggcaccctgaataccgtatccgggccatttttcacttgtttctctacaatctcagatcagaaaacatattctgtcctgcctatttataatcacgaaaaaaactgcggctacctgctgataccggacatggtgcaggccggcgataaaggattgatcctcacgattgaacaagcggccaacgtcatttcctttgaactgctgaaggaaaatgcgctgaagcagttcagccggcgggctcgcaatgagtttttcaacaattttattgagcggtccttttcttcagatgacgaaatcaaaaaccgggcgaaagaattcaagctgcgctgggatcaaaaatacatgtgcattgccggcaaactcgatcgcaatgacgaatcaatcagctttacagaaaatcagctcgcttccgacagcgtattcgaatttcttgaaggtgaattatcagccttcccgtttccgcctcacttctttatgaaaggaaatgtcggcattattctaatcgaggcgacagacagctggagtgaaatgcacgcctcggtgatcagctttttagaacagtttcaaacacaggtcagcgctcaatttaaacgaaccgtgtcctttggcatcagcaatatctgccaaaagctcattgatgttcccgacgctttcacagaagcttctgatgctctgcaatcggggcatttgtcgagaagcaccgcatttatccaggtgtatcacgccaaagatgtgcctgagcttctgcgcttgctcccggttgaggatttgaagaaattttacaactccacgcttcagagcctcgctgaaaaacagcaggaggatcaaagcctgcttcatacgctttccgtctatttagagacacactgccaaatttcagagacggcaaagcgtctgtacgttcatcgcaatacggtcatataccgccttgaaaaatgcgaagagcttctgggtaaaagcttaaaagatcctgaaacaacgatgcgtttgcggcttgccttacgtatgcagcggctgatcagctaacgtttgtcacattttcttacaaaataaatcatttttcgtcactttcagcaatcacacctgcctttttcagctactgtatccaatgacacccctcggccggcacgatatcatgttactaaagttcacatacagggagggactatggtgaaaaaaagatcgtttaaggtgtttacgcttggcctgcagcatgtgctcgccatgtatgcaggtgcgattttggtgcccctgcttgtcggccgggcgctgaatgtaacaactgtacagctgtcctacctattggcgattgacctgttaacgtgcggcgtcgcgacgcttttgcaaaccttgcgcggagcatacatcggcatcgggcttcccgtcatgcttggcagttcatttgtggccgtcaccccgatgattgcaatcggcagcaattacggcattcacgcaatttacggttccatcatcgcggccggtgtgttcatctttttgtttgcgcgttttttcggcaagctgactgtgttatttcctcctgtcgtaacaggtaccgttgtgaccttgatcggcctttcacttgttccgacaggtgtgaaaaatatggctggcggcgaaaaaataaacggcagcgccaaccccgaatacggttcgctcgaaaaccttcttctctctgtcggtgtccttgttctgatcttagtcctcaaccgctttctcaaaggatttgcccgaacactgtccgttctgatcggcatcgccgccggaacagcggcagcagcgatcatgggcaaagtcagcttttcttctgttacagaagcaccgttcttccaaatcccgaagcctttttacttcggagcccccacgtttgaaatcggtccgatcttaacgatgctgatcgtcggaatcgtcattattgtggaatcaaccggcgttttttacgcaatcggaaagatatgcggcagacctttaactgaaaaagatctcgtcaaaggctatcgagcggaaggaatcgccattctcatcggcgggctgttcaatgcctttccttataatacctttgcgcaaaacgccggcttattgcagctgaccaaagtgaaaacaagaaacattgtcgttaccgcaggctgtatccttgtctgtctcggactgattccgaagattgccgcccttgcatctgccgttcctgctgctgtacttggcggcgcgaccgtcgtcatgttcggcatggtgattgcctccggcgtcaaaatgctcagcacagcggatctcaaaaatcaataccacctcctgaccatcgcatgctcaatcgcactcggcatcggcgccagcacggcccccgggatttttgctgaattccccgctccgattagaattctggtcagtgacggcaccatcactggcagcctgaccgccatctttttgaatctatttttcagcttgcgcgacaaaaaagaattaacagcacagcaaacagaacttccggtattagaacatacactcgcattagaaaaagaggtgtaaaaaagatgaaggaacagcacaatgccttacagctaatgatgctggggcttcagcacatgcttgccatgtatgcgggagccattctcgttccgttgatcgtcggagcagcgatcgggctgaatgcggggcagctgacgtatttaatcgcgattgatttgtttatgtgcggggcggcaactcttttgcagctctggagaaaccgatatttcggcatcggccttcccgttgtgctcggatgcacgtttaccgcagtcggcccgatgatttccatcggaagcacttacggtgtcccagcgatatatggtgccattatcgccgcaggactgattgtcgtcttagccgcgggcttcttcgggaagcttgtccgtttttttccgcctgtcgtaaccggatcagtcgtcatgatcatcggcatcagcctgattccaacggcaatgaataacctagccggaggtgaaggaagcaaagaattcggctcactcgacaacgtgctcctcgggtttggcgtcacagcttttatcttattgctgttttatttctttaaaggctttatccgctccatagcgattttactcggtcttatcgcaggaacagcggctgcatatttcatgggaaaggtcgatttttctgaggttttggaggcgtcttggcttcatgttccgtctctgttttatttcggaccgccaacctttgagctgccggctgttgtcacgatgcttctcgttgcgattgtcagcctcgttgaatcgacaggcgtttattttgccctcgctgatatcacaaaccgcaggctgtcggagaaggatctggaaaaaggctaccgggcagaaggccttgcgattttgctgggcggcttatttaacgcgtttccctatacagctttctcgcagaatgtcggcatcgttcagctctcaaagatgaaaagtgtcaacgtcatcgccatcacaggaatcatactggtcgcgatcgggctggttccaaaagcagcggccctgacaacagtgatccccaccccagttctcggcggcgcaatgatcgtcatgttcggcatggtcatttcttacgggatcaaaatgctatccagcgttgaccttgattcgcaaggcaacttgctgattatcgcctcttccgtcagcttggggcttggcgctacaacagttcccgcgttgttttcatctctttcgggcgcggcctctgtcttggcaggaagcggaattgtgatcggcagtttgacggccattgcactgcacgctttttttcaaaccaaacagccgaatagcgcagacataaaaacgtaaaggaagatgccaatgttcacaatggatgacctgaaccaaatggacacacaaacactgacagacacacttggctctatttttgaacactcttcatggattgcggagagatccgcagcactacggccgttttcgtccctttctgatcttcaccgcaaaatgactggcattgtaaaagctgcggatcgcgagacacagcttgatttaatcaaaaagcatccccggctcggaacaaagaaaacaatgagcgatgactcggtacgagagcagcagaacgcagggctcggcaaattagaacagcaggaatacgaggagtttctcatgctgaatgaacactattatgatcgcttcggctttccttttattttagcggtgaagggaaagacgaaacaggacattcaccaagccctgctggcaaggcttgagagcgaacgagaaacggagttccagcaggcccttatagaaatttaccgaatcgcccgctttcgtctggctgacatcatcactgaaaaaggagagacgcaaatgaaaagaaccatgtcttatggcaaaggaaatgtatttgcataccgaacgtatttaaaaccgctcactggagtgaagcaaatcccggaatcatcttttgccggaagagataataccgttgtcggcgttgatgtgacatgcgaaattggcggagaagccttcctgccatcatttacagacggagacaacactctcgtcgtggcaacggattcaatgaaaaactttatccagcgccatctcgcatcctatgaaggaacgacaaccgaggggttcctacactatgtagctcaccgatttttagatacctattctcatatggacacgatcactctgactggcgaagacattccgtttgaagcaatgcctgcatacgaggagaaagatctcagcacaagccgcctcgtcttcagaagatcgcgtaatgaacgaagccgctctgtgctgaaagcagaacgaagcgggaataccataacgattaccgagcaatacagcgaaatcatggatcttcagctcgtcaaggtgagcggcaactccttcgtcggcttcatccgggacgaatatacgactctcccggaagacggcaaccgcccgctgtttgtctatttaaacatcagctggcaatatgaaaatacaaatgactcatacgcttctgatccagcacgctacgttgcggctgaacaagtccgcgacttggcgagcaccgtttttcacgagctcgaaaccccttcaatccaaaacctaatctatcatatcggctgcagaatattagcgaggttcccgcagctcactgatgtcagcttccaatctcaaaatcacacgtgggatacggttgtcgaagaaatcccgggctcaaaaggaaaagtctacaccgaaccgcgcccgccatacggtttccaacattttaccgtgacaagagaagacgccgagaaagaaaaacagaaagccgctgaaaaatgtcggagcctgaaagcctgatgggaaaactgacaacccatattttagatttaacctgcggcaaaccagcggcgaacgtaaaaattggattgaagcggctgggcgaaagtattatgaaagaggtatacactaacaatgacggcagggtcgatgtccctctgctggctggtgaagagctgatgtcaggagagtatgtgatggaatttcatgcaggagactattttgcgagtaaaaacatgaacgcagccgatcagccgtttttaaccatcgtcaccgtccgttttcagctagcagatccagatgcacattatcatatcccgctcttgctgtcgccgtttggttatcaggtgtatagggggagttaagaaggaagcccgcctcaccggcgggcttctttttgcacttcaattaacttttgatcctaggacagtacttgaagtgatccccacacttagtgaaacaacagctagaataaacattcacctatatttttcaggataattgcctacgagaaaaatatcctgtagtcctttcatttataaatcgaggtttcaaactaataagtcagctcttagcagccgagctcccttctccaatcctataaacagaccgcgttttttctcgaaaaaatactctgaagacaattgctgcgtttttaatagttttgataacgcgttctctcttacacctttagacaaaatattcattttttcttttttagacttaaatctatgtcgaaaataatcgttggcatatcttatactatctccactaaaggaggtgacattatgggattctacaattctggtggatacagtggaaactctggttactcaaacggtttcgggagctccttcgctttgatcgtggtgctattcattttgttgatcattgttggagcagctatctttaattattaagtttaactttccttgcctccgccgtatccaacacctccctgtccgacagacgccataagaagtttttatggcgtctttgctatgtgctcactaatctttttgtaattcagaagctgtcaagttctacgagatttatcgtgtgttttcccacaacgcttctgcgtcttgatcgcgctgtctgactgaggctaaaaaagtccggcttttaaaagccggactcccgtctccctccgttcaactctcttctaatcctgcaagctgaccgcataatcccgccgtacccggtacaccggcacaaattccccgccagcccttcttctatatcttcgtcagaaggttgaggggtttcccgaaacagtgctttaagcgcaattatcattcctggggtacagtagccgcattggaagcctccttcttccagaaaagcggtttggcagatatccagttcctcttgttgtacgccctcgattgttgtaatggaatggccgtccacttgataagccatggtcatacacgcattggccagctttccgtcgattaaaatagagcaggctccgcagcggccgattccgcaggacacctttgtcccggtcagctgaaattcctttctaagcaggtcactcagatgtgtcgtaggaacggcagcaacctcccactcttgcccattcacggtcatccggaactgttccttttttacaggaaatggcccggcctcttttatgtccattgcttcagcccctttctgtctatcgcttcaagcagctcttctcttgaaattggcagcttgtttatccagcatccgaccgcatcatgtactgcctttacaatcgccggagtgatggcgattgttccgatttcgccaacaccgcgcggtccatatacgtctcccttcattaagtcttctattgcaatcagcttcatgtcaggaacatctttgattccgggaatcaaatagtgatcgagattttccgcagcataacggccatccgtcattttcgcttcctccatcagtgtgtagccgagtgccatggcagcgccgccttcaatttgacctcgatatccctgcggactgacaaccggacctgccgcaatagcgtgctcacaatctatcaatttgacatcgcctgttaacagatctacctccacctcaacggctgctgcaccgaaagaatacaagaaatgactgcctggtgctactacaggatcaggcgttgttggaaagtcaaaggccgtttcctctgccaaagggcctttttcagccagctccttatacgtcaccacgagcgcctttgtgtttttgtcacgcaagcctgcagcgccgggaataagattttccgctgaacagccgctccattctgccgcccgttttttcaactgagctagaaacggcttcttcaaacgctggatcgcgtgccacaccatgcttgtgccgcgggatgctgtggaggagcctgaattcggcacttttgcggtatccccaataacaatggaaatatcctctgcggcacaacctaactcctccatgacaatctgttcaatcgctgctagaatcccctgtccgcattcttcaaatccaaacgatgctgtgattttgccttcactcgaaagggataaacggcctcctgccgcatccattcggccataccccagcccgccgccgtgcattgtaattgccgctcccgtgcctctttgcagatacccacagttccggctggttcttgtaagaatgggagatttagatatggcattcaacacctgtgccgctccgtcagttggtgcaattcgatgctcaagtggccccaagtcatgcggttttctgatattttttcttctcagctcgagcgggtcgatgccgagcatgccgctgagacgatcgagatgggtttcgagtgcaaatgtgatttggttgccgccaaagccccgaaattcccccgccaccccgttgttcgtaaatactgatattccttcagtccggatattcggaatacggtacggccccgcggcatgctcgacagaaaaatcaagaacagccggtccgagcgtagcatatgcgcctgtgtccgccacaattttcacgtcatgcgccaatagatttcccgaatgatccgcacccgtttttatcgtaatcttcatcggatggcgcttaatgccagaacgtacagattcctttcgtgtctgatggattttgacaggacgtccgcttttcagtgacaaaagcgcggcatacggctgaatattcagctcatccttccctccgaacgagccgcccatcggacttgacacaattctgatcttctcttcaggaatatcaaaaatacgggcaagctggaaacggtctttatagccgtgctgggttcctgcatacatcgtaaaacccccgtcgtcttctggaacggctacgcctccctccgtttccatatacgtatgcatctgccgcggcagctcataggtttcttcaaggactgtgtcagatgcttgaaacccttcttccacatcgccgtttgaaaaaaatgcgcggtgcaggatattcccgtcctcatgcagtctttgcgcatttggccgaagcgctttttctggtgaatccatgacttccagctctttatactcaactcgaatcagctccagcgccgcttccgcgatttcttccgtttccgcagcaactgcggcgatcgcatccccgacataccgcaccctgtcctcacataaaaccggctgatcagggatgacaatgccaaatcggtttaagccgggaacgtctttatgtgtgacgacggcttgtacgccttccattttctcagcttttatggtgcaaatcgacacaatctctgcatgaggataagcacttctcagcaccttgccatacagcattcctggaaagctgagatcggtcatatatttcaattcccctgtgaccttaccccttccatccggtctgactcttgacggtttgttgatgatcatttattcccctccctcagccatcagctctgccatgatgacgttggcagcggctttttttctgtatgccgctgacataaaagcatctgaggaaaacggcagctcatggataagtgttttgtacagatcatgcgagtcccctcctggtgccatccatttcgcttcgctgtccaataatctcctaggagtgatatcggcatggccagcggcgaggcgaatgccgccgtctttcaaaaaacgtccagctgcaatagcaaccgctcctgtaaaagcctggcgccttccaagcttgtgataaaatacacgctctccctccgcccgcggaatgatgacacgcgtgacgatagccgttctaaagtcttcctcactgaggcaagcgccaagcggcagcctgattagctccttttgatatacgataagctcagcaccaagcacaagcagaagcggaatgaaatcaccgattttactcgctatgttgccgccaatcgtggcatggctgcgaatccccggtgcagcgacagcggaagcagcgtcactgaaacagccaagcgctctcttgatcaaagggttctttctgcattcattcagtgatgtgagcgccccgatcgacacgtgggtgtcactggcgctgatccctcgcatctcgtcaatcccttcaaggctgacaaggtgctgtttcggcagagttcctttgtcccactgaagctgaagcagcgtgcttcccgatgcggcacacacatccggagcaagcttctctaaaagcgaataggcctcatcaagcgctgtcggcctccataattgaatattcatccttgcttttgtcacttggccgttcaagccatcgccctccttaccatgtcatattcctcgggtgtatcaatatcgtccaactcaccgctatcctttgcctccaaaaccgctcctgctccaagctgtccgcttttcaggagcctgcgagccccttcatctcctgttaatccctttacataaggaaaacatgtcgacgagaagtagattggcggggtgaacgcccctaaaaacgatgacacggcaaatgactcaggagccagagccacaagggcattgagatgatcgacggaaagctgaggctggtcggctaacaaaatgacaacgccgtccgcccccatgctttctgcttttctcaccccgctgctgactgaatgcccctgacccttttctgcgtcttggcaaacgtgcaggctccagcgtttttgaaaaggcggagcgtgatacggcgctcctatccactcaagggaggcatgttctgtccgctcgacgaccagcacgtgatcaaggcgggacgacagagcagttttcaaggaaagtgagcctatgttttctccttttagcggcaaagccagcttgttttgacccattcttctgcttttgccggcagcgagaaacacgccgatcagataggggtttctcatacaaccgccagccgttttcttgtttgaataatttctgcaactacacttaccgcaatttcctcgggaccttccgcaccgattttcagcccgaccggactgtaaaagtgagatgggggatgttttccgttcagcagccgtttcgtgcggtttgccgaacccaacagtccaatataatggaggttttgagaaaataagaagttgatgatcgtttgatcgtgctgataatgatgggttgccacaacagctgcatcatgcggaaaaaattgaaattcgctaagcatttgttccggaaaagcggtgatcagctgatccgcttttggaaaaagagaggatgtacaataagcgggccgccaatccgtcacgataacagaaaaccctgtgtcagccgccaaattggccagcggtacattatccggtcccgccccaaacagaatgagacgcggcttcggttcaattcgctgaataaacatgttagtggtttgatcgaaatgcggtaaatgaagcgttgaaacagtacgttgaatagcttgcagaggcgcgtccggccagttcccaaaatgtccgttctccgtcagaaataaataatgggaggattcaatctttataacggaagtgacagctttgcctgaatgaaggcagtccctcactttctcatagtgccgccttttttcctgagtgattcgctctgcatgaacatgaataatgccattgcacccggctcccatgccccaagaaagatcgtcctccgaccgcatgtcgtagggaatcagcgttgatgtgagctgatcgcccagcgcactgattctttggaatacatcttcttccacacacccgccgctcagcaagccaatccgtctgccttttttcttaaagagcatagaggcgcctgcttttcgatacgcggagccttcaacttgaacaattgtcgccagtacagcctcctcctggtcttccaggagcgcatctaacatcgtgtgaaaattccccaatgccgcatcctcctctcgaaaattgccgtgagaaacaactagttcagcgtgattttataggtaacttgtataaagaatagacgatggaagaaaaaatgactcatgatttgtcagaaaatgaaacacatagaaagaggatttgtaaaaagagtcaaacgaagaaaatcagattggagaaaacacgaaatcatatcgttaaaaagcttgcggagttccgcaagcttttctttacaccgctgcctggcggccagcgttttcatacacatccagcgctgcttggagcgcttttcctgcttcgattcctgcgttatgtctgagaagcacagcctctaacccggcaagcacgaatagcacgttttcttttctgcagctgtaccccatcgtgccgatcctccagatcttccctgcaagcgggccgaatgagctggcgatttcaatgccgaattgtgccagcagcatgtcacggacagactcgccgtcaatgccgccgggaatttcgacacaggtgacaacaggcattttgcagctgtcatctccaaacaatcttagccccattgcctttatccctgctgctaatgcggcttcatggtgccgatgccgctcgaaacgcgtctcaagaccttcttcaagcaccagtctgactccctcacgtaaggcgtacagcatcgtcgtcgcttctgtatgatgattgagccgtctttcgctccaataatcctcaagctggctcaaatcaaagtagttgcttgtaattggccgatttcccgaaagtgctgccctgtcagcttgtgtcgcaatcccgcgttccacctttttgcgagctgcaatcacgtccgccacccgctcattatatgtaatcggcgccattcctgaaggcacagacaaacatttttgcgttccgccgatggcagcgtcaatcttccattcatcgactttaacctcgcagcccccaatcgttgcgactgcatcgacgataaacaatgcatcctcggtgcggcaggcttcgccgatggctttcagcgggtgaatccgtcctgtcgatgtttctccatgcaccatggccacaattttcggcttcactttttttatctcccgtatgatgttctccgggtcaaaaaccgttccccattcgcactccagcatatgaacatttgccccatatcgctcggcgatttcagtcagcaaataaccgaaacggccgtaaatgggaatgagcacatcatcttccggctctatcacactagccagcactgcttcaattcccgcccgtgaagtgccgtcaatcgggtatgcccagcggttttttgtttggaacagctcccgaagcatctccatcgtttcattcataatacctgtaaacgccggatcaaattggccgacaaccggggtgctcattactcttaatacacgcggatcaacctcaacaggccccggtgtcataatcgttcttaacggggtgcataattctcttctgcctgacacagccattcctcctttatcagtaagccagtttgtataataaatcagtcagtgcgcggacgccgatctcaagctgtctggctgacgtatattccttcggtgagtggctgacgccgcctcggctcggcacaaacagcatacaagcaggatagcgccttccgatcatttgcgcgtcatgccctgctccgctcaccatttcctcacagctgaagccgttttctaatgctgtttcaaaagccgcagccttcagcctttcgtccatcggcacaggctctatccgcatatattcatcaatcacagcgcgaattcctttttgtaggcaaatgccgttgatcaaagcaaccatgtcttgatgaaactgttccagcacatgctgatgctgatggcgaatatcgattgaaaactggacgcggcccggtatgacattggctacattgggctctgccgttatttttccgcatgtcagacggagctcatccggcagctcctccgaccgcagcagcagctcatgaatgatacggctgctggctgcgagcgggtccttgcgccatttcatggaggtggttcctgcgtgattgcattctccttcgagcgtgacgagatatcgcctctgccccgcaatacttgtcacgatgccgagatcccggcctgacatttccaacgtcttcccctgttcaatatgcagctcaacaaacgcgctgatatctgtcctatatgctgactgaaacacacctttgccaaaaccgctctcatgcatcgctgtttggagggagactcccgactcgtctcttggctcttttgcatcttgttctgaaaaaacacccgtcatattccccgacccccaataggtcattggaaaacggctgccttcctcctcacataaggagaccgcctcgagcgttttttttggcgctccgtatgtttccttgagctgctttaacgcgagcattgccgccagaacgccataggcgccgtcgtattttcctccattgatgacagtatcgatatgtgaaccggttacaatgacttcatccggagactgggtgcccgaaagccttccaaacacattgccgacatcgtcgaatcttgtttcaagcccgaaagaagacatttccgttttcacagcaagctgtgcgtccatccactcttttgtgtataaaagcctcgttacgccgccatccgcagacgcaccgtattgggcgagccattcaatataatctgtgatgctgttttttactgaaagcttctgcttttccatgtactcccccctctggccgctatggtgacttcattatagaaggagcaacatgatagttcattgacagattaaccaaaaaaacgtttattttttagccacagtatccatccagcaaccagatacaccctacatgtcacaactattttgatgtaaaggtcaaaagaaaacacggtaaggaagagagccagcaagagcgaaagagagggtcaaaatgcctttcatatgaacaagctaagctggagaggcgatgttcgcggaacggatgaaaacagaaatgccggcagcccgcaaaaacaggacctaaagatatggaaacaggagatttccgcctcctccaaagggactaatttacaattttaatgaaaaatatacaaaatgacacttctatcctttatttcaattttagataatagacatgatctgataaaaggagggcaagtgatgacaaaaaaagcatggtttctgccgctcgtctgtgtattactgatttccggatggcttgcgccagcagcttcagcaagcgcgcaaaccacattaagccttaatgaccgattggcgtcttccccttcaggaacgggaagccttctctcattagccgcccccgctgcaccctatgctgacacagatacctattatgaaggggctgaaggtaaaacaggagactcgctaaaaagcaccctgcaccgtattatcagcggacacacgatgctgtcctacagcgaagtgtggaacgcgctgaaagaaacggatgaagatccgagaaatccgaataacgtcatcctgctctatacgaaagaatcgcggtccaaaaacctgaacggcgggaatgtcggcgattggaaccgcgagcatgtctgggcgaaatcccatggcgattttggtacgagcaagggacctggtactgatattcatcatttgcgcccggctgatgttcaagttaacagcgccagaggaaatatggattttgacaatggcggcactgaatatgcgaaggcacccggaaattattatgacggcgattcatgggagccccgcgatgatgtgaaaggcgatgttgcccgcatgctgttttacatggctgtccgttacgagggtgatgacggctatcctgatcttgagcttaatgataagacaggcaacggctcagctccttatcatggcaaacaatctgtcctgctcgaatggaataagcaggatccggttgacgaccgcgagcggaaaagaaatgaaatcatttatgaaaaatatcagcacaaccgcaatccatttatcgaccaccctgaatgggcggatgagatttggccgtaagaaaaaggtgctccttttgaggagcacctttttctaatacacagcctcttccgtttccgcatcgaaaaagacgacgtggtccattttcactgagagctggattgaatcgcctgcatcgattcgcgtgtttccgtccaggcggaccttgagccgctcgtccccagccatgacatgcactatgagctccgagcccagattttcattcacttccacgttcgcttgaaacactgaatcaaacaactggtcatttcctgtcatttgtgtgatgtgctccggccgtacaccggcaatcatctgttctccggcatatcccttttccttcagccgctttgctttttcttcaggaatatgaagccggatccaagaatttgtgaaaaacagctcgccatgctgctgttctatgatgcctttcaaaaagttcattccgggagagccaatgaagcctgcgacaaacaaattggccgggtaatgataaatgtcatgaggtttcgccacttgctgaatttccccttcattcatgacgacaatccgatctcccattgtcattgcttcggtctggtcatgcgtgacataaatgatcgttgcctctaatcgctggtgcagcttgctgatttctgtccgcatcgtcactcttagttttgcatccagattagaaagcggctcgtccattaaaaagaccttcggctccctcacaatcgacctgccaagcgccaccctttgccgctgcccgccggagagcgccttcggttttctcttcagcaaatgttcaatttctaaaattctggctgccgcatgaacccgctcggcaatttcctgtttcgccatctttctgagctttaatccaaacgccatattatcaaaaaccgtcatatgcggataaagcgcatagttctggaataccatcgcaatatcacgttctttcggcggaagatcattgacccgctccccatcaataagaagatttccttcagaaatgctttctaatccagccaccatccgcagcgttgttgattttccgcatcctgacggccccaccagcaccaaaagctccttatcctttacatctaaatcaaagtccttcacggttaattgtgagtgatatgattttttgacgtgttcaaatgttaatgaagccatcagaaaagtccccctatcttttgacccgttatttcgtcactggaaacaacttggtctttctgttatttttagagtaatcggttcccatttttgctatatttctaaaataaaaaatgtaaatttgtattataacgtcataatacattataatataaataataggttaaaaggaggctaccctttgttaaacaacggaagttctacacctttatacattcagctaaaacaaatcatcactgatgacatcaaaaagggcgtgtattccccaaccgccaagctgcctaccgaaaacgagctttgcaccaagtataacgtcagccgcatcaccgtcaggaaagccattctcgatttagtcgaagaaggctatctgatcaggcagcagggaaagggaacgttcgttaaaagccctaaattaaaacgagagctgatcgctgtaaacggctactcggaatttatggaatcaaccggcaaaaaaccgaagcatcatgtgctgtcccatgacatcattccagcgtcaaaacccatcgcagaaaagcttcaaatccatcccgagagccctgtcgttgaattaaaacggattttatataatgatgatcagcctctcacctttgaagtgacgcattatccgcttgatttgtttcccggcattgatacctttattgctgacggcgtctccatgcatgatattttgaaacagcaatacaaagttgtacccacgcacaatacgaagctattaaacgttgtatatgcccaacaggaggaaagcaaatacctggattgtgatatcggggatgcgctgtttgaaattgataaaacggcttttacatcaaacgaccagccaatctattgctcattgtttttgatgcacacaaaccgtgtcacttttaccatcaacagcccctacacataacaggcataaaaaacgagacactgcttatagtattctcgttttttcactgcttcccccgtcctccaagcgataaggatagccatagccgaaagctccatacacaccgcatgttttcgcagccgtttcagcagcctggcgcaaagcatacgttatatcctgcttcacgcaaaaggcagtcaaaaagcctgctataaaagaatctcccgctccaagtgtatctattatatcagtttccacaatcggctgatgatagactcgatcacccgcagacaggattgctccttggccccctcgggtcatacaaaccattttggctccgtacccatgagctgttttggcaagctcaccgcattccgactcactcaaatcgcttcctgaaaaaaacgcatacgtcacataaggacagaccctcctcaaataatcatcctcccgattggttgaaaaatcaaatgagacagggaccagcccgcacagctgcggaagatcgttctcaagcctgctgtacacgctcgtatgcagcagatcatgcccgctgataaaagatacatctttctcctgaaacgcgaggcgaagccgggactgaatgccgcctttatttgatctgacaaaaatgcggtccccctgttcatcaagggtgacaatcgccatcccgttttctccgtgcgcctggcggatataatctgcattgacctgctccagcttgagaacgttcaacagatgtgccgcggcttcgtcattgccgacgattccgatataggaagactcatgcccgagccgcttggcaagcacagcaacgtttaaggcatttcctcccgggtagaatgtttcttgatcctggtaataatctacaacattatctccaaccgcaatcaatttcatagcgcttcctcctttatccttttacactgccgcttgcaattccgcggacaaaatatttctgcatcaataaaaatagaataataatcggcgcggctgaaatcgttaaccctgccagcaggacgccccagtctgtctgcagcgcgtctctgaactgcatcagcccggctggaatggtccgcaaattctcatcatctatgaaaataatcgcaaacataaactcattccatgtatggtaagctgtcaaaatgccggatgttaccaaaatcggtacactcattggtaagaaaattctgaaaaatactccaaaacttgtacacccatccaaataggccgcctcctccaattctttggaaatagaaagaaaataagagcggatcaaaatgatggtgaatgggatccgataagccgcatacggcaggattaacgcccaatacgtattgtacaggccaagcgactgaataatagaataaagcggcacaagactgacctgcggcgtcagcatcaatccgccaagacatagcaccaaaaagaatccttttcctttaaactcaaaccgggaaaggccatacgctgcccatgcactgataaagacagtgatcacacacgtcagcgccgtaacgatgacactgttcataaaataagaagaaatcccctggttccaggcggaaacaaaattttccggatgccacgaagacggcagcgaccagctgtgctcaaaaatatcgtcagagtttttaaaggcgctcatcaccatccagagaagcggataggcaatcgcaatcagataaagaaacagaaaaacccacacagacgtttctccgatataccattttcgtctaggctttcttttcacctcaatgtgctggtcaggcacaggctccaatctgaacgaatctgtcttcttctgaggcagcatcagttactcctcctttccggttttaaagaacttcatttgcatgagcgataatgcaagcgtaatgattaacacgacagtggcaatcgctgaggcgtagcccatcatatcctttgtaaaggcgcttttatataaaaacgtgctcaagacttctgacgcgtttcccggcccgccgcctgtcaaaatgtacggctcattaaagaccgtaaaggccccggtcagcgtcatgaccaccgcaacaaaagacatctctttcgtctggggaacagtaatatgaaaaaactgctgaattttacccgcgccgtcaagccgggccgcttcatacagttcatccggtattttttgaatcgacacgatgtacagcatcgcaatataaccgacagattgccactgggacacaaaaatgacagaaagcatagctgtgctgtcatccccgagccaggccctcgtcagctgatcaagaccgatggcctgaagcagctgattcaaaagccctgtctccggattgtaaataaaatcaaacaaaagcgcgatcacagtcattgagatgacaaccggcaaaaagaaaacggtacgaaaaaacggcgaccattttctgaccagcttatcctcaagcaccgccgccaaaatcaaaccgccaaatacctggcatacaattgagatcactgcataaagcacattattggtaagtgcctgatagaagacaggatcatgaaataattcaacatagttttttaagccgataaacgttttttccggagaaaatgagctccactgaaacaggctgaggaatacattctcaaaaatcgggatataaacgaaaagtaaaaaaacgagagcgggcaccaaaaacaaataggggattattttattctgattgaccaagggtatctcatctcctttataaaaagaaaaggtgcgaagcttcaccttttctttgatttattcagctgacgccctcacctgctttgctgccttttgaacggctttcatcacctgctgcggtgtcatgtcgccgccaagcatttgctggacgcctgttaggtacgcatctgcgacttcaacatcgacatccatatcaaaccatggaaccattgatttggcatcaacaatatgctgaacggcttcacgctgaatagctgttgcattttcttcagtagccgtaccttgcactgcactgtatttcccgacatctttcacgagcttttcgcccatttttttcgacgtcaagaactgcaaaaattccattgcttccttcggatgttttgttcttgaggaaatcatgaatccttccggcgctcccgttaacgcttctgaagatcctttctgcccgctgatttcaggaaatgggaacatcccaagattaaccggttcaaccagcttgatttcggctgtttccgcatatatcatcgccgactttccgctcttaaattgctgtctcacatattcgtggtcgacggagtttacatgtttattaaagtaaggcatcagctcttgaagcttttcaagtgcttttacatagccttcatcagtaaattcacccgttttggcgttatagtccttgtctcgcgttttttcatcgaccatccgctgattaagcgtgccgatatagtgcgagattgtccaagtcgcctttgttccgaagctgatcggtgtgtagccatgttctttcagcttttttgacacatcgattaattcatcccacgtcttcgggggatcaagattcagcttttggaaaatgtctttattatagaagaatgatttagcgtccatttgccacggcacgccatattgcttgttgtcataagtaaatggtgtaatttgcgattgaacgagctgtgatgaccaatcggtgtcatttttgtagtaggacgagagatcaagtgctttattgcctctgataaatttaaaagcaaactcatcgctccaagagaagtaaatgtcaggagggctggtggttcccagcatgaccttaattttatctttataggagtcatttaaaacggcttcaatttgaatatcgatatctgggtgttctttttcaaattccttaacaacctcttcaaaataacttttttccggctcctttggccatctgtggaaaaatttcaatgtcacctttccgtccgctgaactgctttggctcgaacagcctgcaatggtgaacatactgacagctgcaatgatcaagaacaacaacattttcttcaaagggttggcctcctctggacattagactataatgttatataacattatagtctaatgcataatggttcctcattttcagatcaatactcaactttccacatgtatcttctatgagataaaggatgatttctcgcctctgccagctcgtctgcatagcttctcagcacacgattgagaacgagcggggcaagatagcctttaactgaatcgtcaattgcagtgaagtcgtaagatgcagcatcaagcacagtgagctttttgccatactttttcgagaaggtaagcgcccgctcttcaagaggtcttgtttcatctaaaccgagcaggatgataaacggcacggattcatcaataatttcaaacggtccgtgaaaatattctccggcatgaatggcgtgggaatgaatccattgcatttccatgagaatgcagatgctgtaggagtaagcgacaccgtagtttgcaccgcttgccatggtataaataatgctttctttttcatgggcttttgcaaatttcttggcgttgtcagcttcctgcttaagggctttttcatatacagcctgcaattgatctaagccttcaattgcttgttggaatttcgtattgttttctaatacttgcagggttccaaaaacgatttgatacaaaacgccatagtttgtattgatcgcaagcgcctcatcaccccaatcgtactgggcaacatattgcgcttcctgcgctaaaggagactccggtttaaacgtcatcgcaatcgtaagtgcacccttgccccttgcaaacgcagcagctttgactgtctccggggtatttcccgaatgcgagcacaaaataacaagagacttttcaccaagctgaacagggttgcgctgaataaattcgttggcgctgtagaggtcggagtttattgattttgactctctgtcaaacacatacttactcggatacataatggcagaagaccctccgcatgcgacaaagaatacatgatcaatggttttccctttcaaatcctgcaagaaagcttgaacctcacgatttacttttgctgtggcctgactcaaatccttcactccccgtttttattatataacgttatataacattatatattgttatattaaagtccgcgggtaggattgtcaatattattttctgaaatttctcaataatttattcgaatgatagacaaagggtctatacgcgaaaaaatgcccaaatcaaaagccagaacttgacttaagctctggcttcgctgttcaatccgcagactgacgtcttatttaaaaaataccttgtctatattgtacttcgagtgctgtgtattgatgatatatgtttcgtaaatctctctttccattggatcatcaactacacatacctcaattttataaacttcatctctgtgatgtttgatcggtgaaacagtgtcttcgaaatgcttcttaattctctgtcttaactttctggctttaccgacaaacagcagctcgtcatgaatgttgtaaaacataaaaatgccgcctttgtcccttgggatctggtgaaagtcgatgaatccgtgaatcggttttatcttcggttcgttatcattagctgactgctgtcgttcagtgatggtgacattcggtgcgggtatatcaatttttatcaaaatcagttcacgtcctctttttcattaaagataaatgctaacacatacagaaaagaaaagctagaacagctttattatatttgtttgttatgctcttgcttattatgcaagtgctccggctggatgataaggactaaggtctaattctgtctgctttccgagaactagctttgcgagctctgcacccaagaacggccccatcgtcagtccagaagcacccaaaccgtttgcagcatataggccttgaacattcggcacggcccctacgaccggcagaaaacccggtgtaaacggcctgaagcccactcttgtttcaacagcagccgcatcagcaagacccggtgcaacggctaacgctttgctcaatacttcgtgctggcctccggctgtcacacgaagatcatcaagaccggcatcattttcgtgtgtggcgccggctacaattcggccgttatcaaacgaaagaatgtactgatcactcggcggcattacaaccggccacgatcctgtatctgcatctgtcatttcaaaatgcataatctgcgctttttgaaatgacacttgaaaatgaatgccaagaggcttcaatatctcattggcccatgctcccgccgtcacaatgaccgcgtcagccgtaaactgctttgcatctgtttgcacgccggtgactgttccgttttcaaaaagcaaagacgcatttcctttgatgaccgttgcgccgcgtttctctgcagcacttaaaagcgaccggcacagcgctcttccgttcacacgggcggcaccgctgatatgaaccgattcatagccgtcagctaaaatcggaaacagctttttcgtttcacttgcagacaagcgggtaatgtcgccgatttccggcgcatcctcccgtctcttatacgctctttcctccattttatcgagtttagacgcgtcagtatgaatgctgatagcaccgacacgtttgtatcctgtatccgattcaccgtctttttccaattgatggattaaatccttatagtaccgcgctccccccttagcaagctggtaccaatcctgattacggcgttgcgagagccatggacagacgatccccgccgccgcatcagtcgcttgtcccggctctttccgatcaatgacagtaacgcgagcacctgattttgcgagatgataagccgtcgacgcgcccagaatccctgcgccgacgatgatgtacgatttcatatgcaaacaccttttctattataatgtctattcattttaccaaatagaatgctttccttcgaccttttgccctaatgtggaaaaaccgcgaagttcgtccaatctctttactctcctatcgaatatcctgtcactatcaatagagaaaggatgataccatgagcgaaaatcgtcatgaaaatgaagaaaacagacgcgatgcggcagtcgcaaaagtccaaaacagcggtaatgcaaaagtcgtggtcaacgtgaatacagatcaggatcaggcacaggcgcagtcacaagacggagaagactaatgaacgaaaacatcattcctctcaacagacatactcaagagatacccactactgaatctgttatcaaaaacagcggcaactcagaggtccatatcgacattcacattgatacaatgccaattgcttttgctatattatgctctgcattagccgcaaagcagatgacaaaagaggaattcgatatggcttatactcaattgcgagagatgaacagagaaaataacagcagatcatctgtaaagcaaattatcaatcaagagacagaagaagagtaaaaaaccgcggcccctcggccagcggtttttcttctgcatacaaaaaggacgcgactgaatcggttacttctgtacaatttgaataaggttaccgcatgtatcgtcgaagacagctattgtgacttcgcccatttttgtcggttccatcgtaaacgtcacgcctttttcctttaatcggttgtactctttttgaatatctgcaacgccaaacattgtggccgggaggccttcggagaatatcttcttttgatactccttggcggcaggatgttcattcggttcgagtaaaagctcggttccgtcttgatcatctggagaaacaagcgttatccacctgaatttccccatgggaacatcctccttttttacaaaccccagtttttctgtatagaacttcagtgccttgtcttgatcttgcacgaatatactagtcacaatgattttcatattgttgttgcctcctttgatatttatggtacatggtactgtgcaaacaatccggcttcaagcaaaacaaaccaacttttgtcagaaactcagtactggttttataaaattactcgatccatcctttcagcaaatttttaagcggttcgttgttgaatataagtactcgatattttccctttcgttttgatgttacgagtcctgcatcctccagtacagaaaggtgtttagctatcgcctgtcgcgtaatagaaaggtcgtactttgtaataagacgtatcgtaagttcatacaacgtcagctcgttgcgttcagataattcgtctaatataagccgccgagtcgaatcgccgagtgctttgaatatagcgtctttgttccaattcatctattgagtataagcaactcattagttgcatgtcaagtataagcaactgtatggttgcgtgatataggtactgaacctatccggcgcagtctgaaatattctaatcgataaggaattaaaaccatcaaaataacagtggatatgtctctgaaaaataaaagaagacgaacttcaaaagttcgtcttctacaatcaaattcggcacgccggccattttaaagttgataactatctcgcaaccccttgataaacaaaggagttttcatcattaaccgatagaaccttccatttcgaacttaatcaaacggttcatttcaactgcgtattccatcggaagctcttttgtgaatggctcgataaagcccattacgatcatttcagttgcttcttcttcagaaataccgcggctcatcaagtagaagagctgctcttcagatactttagacactttcgcttcgtgctccaatgaaatgttatcatttaagatttcattgtaaggaattgtgtctgatgttgatttgttatccataatgagcgtatcacactcgatgttagagcgggcgccttccgctttgcgtccgaagtggacgattccgcggtacgttacttttccgccctgttttgaaatcgattttgatacgattgtagatgatgtgtttggtgcaaggtgaatcattttcgcacctgcatcctgatgctggcctttacccgcaagagcaatagaaagcgtcataccgcgcgcgccttcgccttttaggatacaagccggatatttcattgtcagcttagaaccgatgttgccgtcgatccattccattgttgcgttttcttcacagactgtacgctttgttacaaggttgtaaacgttgttcgcccagttttggatcgttgtataacggcagtagccgccttttttcacgatgatctcaacgaccgcactgtgaagtgagtttgttgtgtaaacaggcgcagtacagccttcaacataatgaacacttgcttcttcgtcaacaatgatcagtgtacgttcgaactggcccatgttctcagagttgatacggaagtaagcttgaagcggtgtttcaaccttcacgcctttaggcacgtagatgaaagatccgccggaccaaacagctgagttaagcgccgcaaacttgttatcagtcggcgggattacttttgcccagtgctcacggaaaatatcttcattctctttcagcgcgctgtcagtgtctttaaagacgatgccttgcgcttcaagatcttctttcatgttgtggtatacaacctcagattcgtactgagcagaaacacccgcaaggtatttttgttcagcttcaggaatgccgagcttgtcgaatgtttgtttaatttcttcaggaacttcatcccaagaacgctctgaacgctcagacggttttacgtagtacgtaatttcgtcaaagttcagtgagtttaaatctccgccccattgaggcatcggcatgttgtagaaatgctcaagtgatttcaagcggaagtcaagcatccattgaggctcttctttcatgcgagaaatttcttctacgatttcttttgtcaatccgcgctctgaacggaaaatggaaacgtccttgtcgtgaaaaccatacttgtattcaccaatatcaggcatttttttagccatccattttcactccaatccttttaattgccgccttcttctttcgcgactcctttttcaagtgctttccatgacagggttgcacatttgatacgggccgggaattttgaaacaccttgaagggcttcaatatccccgagatctatagaatcatcatactctttcccttgcatcatatccgagaaaatcttagacatggaaagggcagtttcaatatctttccctttaatcgcctgagtcatcatcgaagcggatgccattgaaatagaacagccttccccttcaaacttcgcatcttccacgatgtctccgtcaagcttcattgtcagtctgatgcggtcgccgcatgtcggattgttcatatccacgacgatgctgtcattcaaaacccctttatttcgcgggtttttgtaatgatccataatcacctgtctgtacaatgtatctaagtttgcattaaaagacatttgtaaaatactcctttgtcttttgaagagcttccacaagcttatcaatctcttcctctgtattatacagataaaagcttgctcttgcagtagcagttacatccagccatttcatcagcggctgcgcacaatggtggccggctctgactgcaattccctccgcatcaagcacagtcgccacatcgtgcggatgaacatcatcaaggttaaatgtgacaagcccggcacgctcttccggcccgtaaaccgttacgccgtcaagctggcggaagcgttcaagcgcataagctgcaagcttgtgctcatggcgggaaatctcatcaagaccgatttcttcgagaaaatcaatggcggcaccgaggccgattgctcctgcaataatcggcgtacccgcttcgaatttccacggaagctctttccaagttgattcataaagcccgacaaagtcgatcatttcaccgccgaattcggcaggctccatgttttccagcagggctttctttccgtacagcacaccaacaccggtaggtccgcacattttatgggaagaaagcgcaaagaagtcgcaatcgagatcctgcacgtcaattttcatgtgaggcgtgctttgtgcaccgtccaccacaatgacagccccattgtcatgagcgattttcgccatttctttaatcgggttgaccgtgccgaggacattagatacatgagacaccgcaacaatttttgtgttgcttgtgaccgtttctctgacgtcttctaaagaaatcgttccgtcttcctgcaacggaatatattttaatgtggcgccagttgcttttacagcctgctgccacggaatgatattcgcatgatgctccatgtaggtgatgaccacttcatcaccaggtttcaggttggcgcgtgcatagcttaacgccaccatattcagtgatgtggtcgtgccttttgtgaaaataatctcagccattgacttcgcgttaataaacttgcggactttttcacgcgctccttcataaccatctgtcgctctggttccaagtgtatggacgccccggtgaacattggaattgtattggttataatacttatccagtgtttcaatgacagcacgcggcttctgagaagtcgccgcgctgtcgagataaacgagatcatgtccgttcacttgctgatgaaggatggggaactgttcacgaatatctgtgatattcattacttcactttcctttcgataacagaaactaattgtttcttaacgccttcaatcggaagttcatttactaccggtgcaaggaatccgtaaatgactaagcgttctgcttcttctttcggaattccacggctcatcaggtagtaaagctgaatagggtccacacggccgacagatgccgcatgtcctgcagttacatcgtcttcgtcaattaaaagaatagggtttgcgtctccgcgtgctttttcgctaagcatcagcacgcgtgattcttgctccgcattcgctttagaagcgccatgttcgattttgccgattccgttaaagatagaagaagcggaatccttcatcacaccgtgcttcaagatatagccttcagaagctttaccgaaatggatgatttgtgttgtgaagttttctgtctgctctcctcttccgacaacaaccgttttcgtatcgccgtatgtgccgtcaccgtaaaggtttgttgtattttcggaaatcgtgtcgccgtcgttcatcaggccaagagcccactcgattttgctgtcgcgtccgcgcgcagcaccgcggcggttcacataagttgtcacaccgcttgacagattatccaccgcaccgtatgtcacgctggcattatcacctgtgatgacctcactgataatattgaagacagcgtctttcgggtttacagtgctgatgtagttttctacatatgttacagaactgtggtcttcagccacaatcagcacgtggttgaatagagctgtatcattgctttcgtggacataaacagcctgaaccggcgtctccacctgaacatttttcggaacataaaggaatgctcctccgttaacaagagccgcgtgaagtgcagttaacttatgttcgtcaaccttcacgccgtccttcataaagtatttctccaccaagtcgctgtgctcgcgtgcagcagtcagaatatcagtgaagatgacgcctttgtctttcaattcttgagaaagagaaagatgtgccggcgtctggtcacgctgtacgtataatgttttatcttcgttttcaatgtcgatcagcgcttttacttcatcagtcaaatcttctaatgaagaaagcggttcgttatccactgtatgcttcgcgaaattcgtgaagttccagtttgtgatttttgttttgtcaggtttcggcatcggcagatcctcagcttgttcaagagcctgtaagcgcaggttcttcagccaggcaggttcttggtgcttttcggaaaagcttttgagatactcctgatctacggatagttttgtacctagtgtcatattaatccccctaacgcttacgcttcttggccaacagtttcgtcttcaatgccaagttcttgtttgatccagtcataaccttctgcttcaagacgctgtgcaagctctgcaccgccggattttacaacgcggccttgcatcataacgtgaacaacatccggagtgatgtagtttaacaggcgctgatagtgagtgatcatcaagcagccgaagttttcgctgcgcattttgttgatcccttttgatacaactttcaaagcgtcaatatcaagacctgagtcaatttcatcaaggatggcgattttcggttcaatcatcattaattgaaggatttcgttgcgttttttctccccgcctgagaagccttcgttaagatagcgctgagccatttcggggtccatttcaaggaactccatgttttcgtccattttgcggatgaatttcatgagagaaatttcatcgccttcttctctgcgcgcgttgattgctgagcgaaggaagtcggcatttgtcacaccgctgatttcacttgggtactgcatcgcaaggaataagcctgcctgcgcacgctcgtccacttccatctccagtacatctttgccgtcaagcgtgatgctgccttttgttacttcatatttaggatgccccataatagcagctgataaagtggatttaccagttccgttcgggcccattactgcgtggaattctccaccttttatttcaaggtttacaccctttaagatctctttcccttcgatttcaacgtgaagatctttgatcgttaatgttgaagcagccatatctatacctccaaaaatatataatcattattctcattttattctcattctaattttataacaaatgaaaagtaaatacaactttttatcgtgccttgcacattcctcaagtttaacaaagatcagcactttattaaagcgattgaaaaagaaaaagagtggattcccacccttttttaaaagattgattttctcaataagctcccgcagaaatccgcttgcttttttcataatcaagctctctctgccgctctactttcattcttgtttccagccggcgtccatattcctcgtatccaattccgtgtgacagctgcatcgctttttccatttctgacgtataatcgaggttcagtctgtcctggctgctgcaaataatgaatcaatcccttcatatatttgctttttattgtaccagtgctgcgttggatgccgcaaaaacgatttggcgtgaaatagcggcagatgagacgaaagcatcctttcagaacaaatgagaatggtttttcggaatattccttctcttaatgcgtggtgtttccgaattcctcaatgcactgttgaacgactgtcacgccttggctgaaagctgcgccgcctccaaatgccgctgccacactgacggcttcgagaatgttttcttctgtcgctccctgatcgagacagccttttgtatgatagatcatgcaatattcgtcctgagcattgatggcaattccgagggcgatcagctgtttttctctttcagtcagagaattcccggcaaagcactgttcagtaaattcgttaaattttcttcccatcagcggcatcttttgttcaaatgtgcctaaaccatgtttatattgttttaacgcgttctgcatgcttcctctgtcttgattcaaagaaaatccctccatctgtttaacattcctttttattatgaacagcttttaggaaaatacgcgaaaaaaaccccggatttctcatccggggtttcaccgtgtcagcaaaccctcgcattcgttgtcagacctgcgcgttggtgctcacgaattgcaacattcgctccgctccaatgctcggccttcctagacttcaagggttttcaatcacgctgaaaagatgacaaagccctaaaacgaatatcgttttagggctttgtcaataattgaaccccggatttctcatccggggtttcagtcttattcagatacaggaagcacagctccgtcgtattttttctcgatgaagtctttgatctttttagagtgaagaacttccatcagcgctttgatttttgcagaatcttcttcgccttttcttactgcgatgatgttagcgtatgggttgtttttcgttgattctacttcaattgcgtcttttttaggatttaatttattttggatcgcatagtttacattgatgaagaccgcgtctccttctttgttttcatatgcttttgccgttaattcaggcgctacttttttgaattcaaggtttttcgggtttttcttaatgtctttcaatgttgcgtcaactgtttccactttagaatcaagagtgattaatccagcgttttcaagcattgcaagcatacggccttgttcagcaacgttgtttgtcagaatgattgtcgcaccgtctggaaggtctttcagtgatttgtatgttttagagtaaataccgaatggctctaagtgaacagcgccggcattcacaagtttgtaatctgtgttttctttcatttcttgctcaaggtaaggaatgtgctggaagtagttcgcgtccacttctttatcagctaaagctttattgtacattttgtaatcacttagcactttcactttcagcgtatagcctttttctttcagcaatggttcagcttcttttaaaatttccgcatgcggtgttttcgttgccgcaacgacaatttctttcttgccggattcagcgccgttattcgaaccgcaggcagccataactcctgcaaatacaagcagtaatgcacccaaaaatagctttttcaatgtaaatcctcccttatcgtttgtctataatatttgttattagatcaccgatgatttgaataataaacacgatgattaaaataaacacagtagcaacgaaggtaacatcagcgttattagactgatatccttctacgtacgcaaggtttccaaggcctcctgaaccaatggctccggcaattgccgttgagccgatcaaagcgatggcagtaaccgtaatgccagaaataagagcaggcattgattccggaatcagcactttgaaaataatcgtagacgttttcgcgcccattgatttagcggcttcaatcacacctttatccacctcacgcagcgcgatttcaacaaggcgcgcgtaaaatggtgccgagccgattaccagcgccggcaatgcggcgtttggccctaagatcgtgccgactaaaaatttcgtaaaacctaatagtaaaataattaaaataaggaacggaatcgatctgaatatgttaacaacggccgcaatcactgagttgaccgctttattctgccagaggcttcctttgctcgtcagaaagagcagcaagccgaggatgaccccgatgacaaaagcaaacagtaaagaaatcagcgtcatataaagtgtttcatatgtcgcgttccataattcagttaaatcaacgttcgggaagtatttttcaaacattcgtgatcacctctgctttcacctgtttgtcattaatgaatcggatcacgttttgcacttcttcctcgtccccgtcaatgtggatgaacagtgaaccgtaagccccatccttcgtctgcgaaattttcccttgcagaatattgacgctgacattgaagtttctgatcatctctgtaatcagaggctgttcagctgactcaccgacaaatgtgagctgaaccatttttcctgatgctgtatcatcaagaaggtgctgaagcgtctctttcgtttcttccggctctgtcacctgctgaacaaatcgttttgtcatttgttcctttggatttttgaagacatcgagaacctcgccttcttcgaccaccttgccgttttccatgacggcgactctgttgcagattttgcggatgacatgcatttcgtgcgtaatcagcacaatcgtcaaaccgagtctttcattaatatcggacaatagatccagaattgaatctgtcgtttgcggatctaatgctgatgtcgcttcgtcacaaagaagaaccttcggattgtttgcaagcgctctggcaattccgacacgctgcttctgcccgccgctcagctgagacggatatgatttttcttttccttctaaacctaccagtttaatcagttcattggcgcgcttgatccgctcgctctttttcaccccggcaatttctaaaggaaacatgatattatctctgacagtccgcgaccaaagcaaattgaaatgctggaaaatcatactgatctcatggcgtgcttttcttaaaccgcgtccatttacttcattaatcttggttcccgccacttccacggttcctgaggttggtttctcaaggccgttcagcagacggattaaggaactcttaccagctccgctatatcctataattccaaaaatctcaccttttttaatggaaagcgagacattttggacagcattgacatctccatgtttcgacttgtaaacttttgaaacatcctgaagattgatcaaagcaatcacctgccttaacactattctaagaaatcttccggttttttctgcaaaagaaaagcctttctgcacacttgagcagaaaggcttatataaaatgcctttctctcatctttcaaagctgaacgcttcgtgtgaattggcaccatttcaacagtgttgatggttgccgggcttcatagggcacttccctccacctctcttgataagagaaatatatagtctttttcgtccggaaattcttaatgtagaatagcacggcgaatgattaaatgtcaataaaataaatgatgtcaacttttactattataataatttattattttttaattttttaaaatcctctgaaaaaatccatttgtcagccagagaatggcttccagttttaacagggccctgaatgacccctttactttgaggcttccgctctgaatcaggtgctgaagggaaatgtctccgtgcaataaatcaataatttccgtttggtttccgtaaaaggtcaggttggacgtttggggcggagaaacttttttcatttctccctgttcgtttattgagacggttaaggcttctgcttctccttggaaggtaatgagcaatgttgaggcattcaaaaggggttttaaaaacagatgctgatactcatcctctaaaacttccgctttctccatatgtacaacctcctatttgttggtcatacatacacatttctctctttgtcgcaagaacccctttataaaacgaacgacaatttcattggatttgctgagaaatatgtcataaatgggatgcggaagatgatttttgtttgatcagctcatataaataagaaacggaatgaaatgcatatcctctttcgaccatctttccgcctttaaacagcagaaaacaagggacgctttcaatttgatacgcttttgcgaatgtcggagagtaattgacattgttttgatagaaggcgacatccggcagcatttctttcaccactgtcagcattttgcttgcaagctggcaggtgccgcaaaacggagtatataaatatagaaggtacacatcatcttcaatgtgatcaagttcgtgttcttggagttctttcatgctatacacctcgggactttctttcaagaaaaatagtatggacattcagattcgcacgcagcaatacagaggcgacatggtgcctgggcgcagccgctacttccttataggctctgtcgatatggagatggcaggcttcattaaattcacgcttcagctgttttctcaatttctcacctgattcatcagcatcaactaatatatagacgtctttatcataaagctcgtcagccaattcctcgagcctcagctggctgattgttccgtttgtgcagataatgcgcatcggttcattcaggacgctttcgattttctctttatctgatttcccctcgacaatcataaccttttgcagctcatccatcttcatcttgttcacctgccgcgtcaaatttgaaacgttcagattgtaaaagaaggcagtgaaattcaccgccaacattaacaccagccgttttcgtagtcacaatctacatattttgcgtcgtctccagagaccacatcggctgtcttataaaatttctcattttcaaaggaataaccggacttaagctcatattcattcatgcttgtcatttggccgatcatctcattatcatgatataacgagagccggccattttgaaagcggcctgtcacgtcattggtgacatcgagcttttgtttgtcgaaagccatattggacacctcccataacgttagcgtgtccaattgcttttacggctatcctgttttagtcttcttgtgtcatctcttcgtattgctctgctgtcatcagtttttcaatttcagaagcgtcagatggctcaacgacgatcatccatgctttttcgtacggagattcgttgacgaattccggactgtcatcaagatcttcgtttacttccacaaccgttccgttaatcggtgcataaagctcagataccgttttaacggattcaacactgccgaatggctcgtccgctttgatttcagcgcccacttcaggaagttcgacaaacacgatgtcgcctagttcggactgggcaaaatgcgtaattccgattctggctttttctccttcaacttttacccactcgtgttctcctgagtaacgcaaatcttttggtatgctcaattgaatccctccattttttacagcactacaataagaagataccacacttttcaaaaaaaatttacattaagcccagttttcttcaaattggtcttctttaaatccgacagtcactttttcgccgtctgttgtaagcgggcgtttgatcagcataccatctgaagccagcagctcgagctgttcgtcctctgacatgtgatacagcttttccttgagattgagctcgcggtatttcatgccgctcgtgttgaaaaatttcttgagatccagcccgcttttttcataaagcgcttttaattcttctttgcttggcggctgctcagcaatatgtatttcgtttatttctttcccatgctcttcaagccacttctttgctttgcggcacgttccgcatttagggtaccagtaaaaagttaacgacatcttcttccccctcaataaaataatcgaggttattttaacacagtttgttttaaaaacctaaaacagtgcttcttaaaaaagagctccgcgcatgcggagctcatggccaatcagacaatatatttctcagcctcaaaaatgcctgccgccgcctcgcgttttttctgaatcacgtttttaggcgttacgcgtgtcagcttgcgcagagcggaaagcatcatgcggagtgaatctccttcttccattgcgataagggattccttcgcatgcgcttcaatttcgttaaaggcctcttgaacgaaaatttctgtgtacagcaccttttgcgctgctttttcagcgccttgtgcggcaatggccttttccgttctgagcacggctgattccattgcgtatacattgctgacgatatccgctacgttcacgagaatttcttgctcacgatcgatcgcttttccgtatttttgcgcggctaggccggcagcaaacaacgcaatttttttggcttgcttgacgatatatttttcctgctctaagacgccgcttccaggctcttcaggcataagcatcatgagttcttcctgcagcgactgcgctttttcgaataaaggcagctcgcctttaagcgcttttttcaggaaggtgcttggcacgattaaccggttgatttcgtttgtgccttcaaaaatccgattgatccttgaatccctataggccctttctacttcgtactcctgcataaagccgtagcctccatgaatctgcacgccttcatcaactatataatcaagcgtttcagagccgaataccttattcagagagcattcgatggcgtattccgcaatcgatttggcgatttgccggccgtccttgagatcttcggccgtgaactggctcatattgtcttcaaacagcccgacggttctgtatacagagctttccatcgcatacagccttgaggccattgtcccgattttttcctgtgttaatgaaaaaccagcaatcggcgttttaaattggcggcgctgatttgcgtatgccgcagacagctcgatgacgcgtttagatgcgccgattgtgccaaccgccagtttgtaacggccgatgtttaaaatattaaaggcgatgacatgccctttgccgatttctccgagcaggttttcctttggcacttcagcttgatccagaatgagagttcttgtcgatgatcccttgattcccattttcttttcttccggtcccgtggagacacccgggaactctttttctacaataaaggctgaaaacttgtcgccgtctaccttggcgtaaaccacaaatacatcggcaaaagcagagttggtaatccactgtttttcccctgttaatacataatgggttcctgcttcattcagcacagctgttgtttttgctccaagtgcatcagacccagagccaggctcagtcagagcataagcggcgatcttttcgcctgaagcgagtccaggcaaatattttttcttttgttcttctgatccgaaaaagacgatcggcaaggaaccgataccgacatgcgcgccataagaaagagaaaagcttcccgcacgcgaaaatttctcagtgatgagtgccgagctgattttatctaggccgagcccgccgtattcttccggcacatcggcgccaagcagccctagttcgcccgctttcttcaacagtctgacagaatgctcgaattgatggttttcgatatcatctatatgagggagaacatcttgctcgatgtaatcctctgttgttttcgcaatcattttatgctcgtcagtgaaatcctccggtgtatacatttgatcgtatgtgacatcctcgattaaaaatccgccgcctttttgtacgtcagccgctttttttgccatttgtttttccccctttagcataattcaaatacaccggccgctcccattccgccgccgatacacatggtcacgactccaaattgctcgtttctccgtttcatttcatggatgagtgagagtgtaagctttgtgcccgtacagccaagcgggtgtccaagcgcgattgcgcccccgttgacattcactttttcttcatcaattcccaattccctgattacttgaatggcctgtgaggcaaaagcttcattcagttcaaacaagccgatgtcctgcagctgaagtccggcaagcttcaaagcgcgcggaatcgcttccaccggtccgattcccatgacttccggcggcacgccgcctactgcaaaggagcggaatttcacaagcggcgccaggccaagagcatcggctttttcccggtccatcagcatgacagccgccgctccgtcacttgtctgtgaggaattgcccgcagtcaccgtcccgtcaacggaaaaggccgggcgcaatgtcgataagatgtctgcagtcgtttgcgggcgaacaccttcatcctgagaaaacacaaactgtttttccataggcttatggtcttctccgatttctgtcaccgtcacttctacgggtacaatttcatctttaaattttccttctgcaagggctttagcagcgttttggtggctgcgaacggcaaacgcgtcttgatcctcacgggagacgccgtattttttcgcgacttgctcggctgtgtggcccatgctcatataatattccggtgccttttctgccaaagcaaggttcggacgggtaacatgccccatcatcggaacttgcgacatggattctgctccgccggcgatcgctgtatcgtaggcgcccagcataattttttctgctgcatatgcaatagactgaaggcctgaagagcaataacggttaactgtaatcgccggaaccgtgtacggcaggcccgcgagcgcaccgatatttctcgccatattaagcccctgctccgcttcaggcgttgcacagccaataatcaaatcgtcaatattgccttcgtagccgcctgcccgtttcagcgtctcttttacacaaatcgctcccaaatcatccgggcgaacggtggccaacgatcctttttttgcttttccaaccggtgttcttgcacctgacacaatgactgcctctttcataagctccctcctaattccgtaaaggtttacctttcacaagcatatgctgcattctcgcttgagattttgcctctcctgccaaactcaaaaacgcttctctttcgatctccaataaatactcttcatcaacctctgtaccaaacggcacttttccgcccgcaatgacataagcgagttttttcgcgatcttgaaatcatgctcagatatatagccggacagcttcatctgctcagcgccaagcaagagtgccgcataaccggtttctcccggcaccttgaccttttcttttacaggcggccgccagccggtatcgtataaagatgcggccagctgcttcgcatcgtataacaggtggtcttgattcacgctgatctgatccgtttcttttaagatgttcatctcacgagcctcttgagcggaagcggacactttcgccatcgcgattgtttcaaatgttttcattgccgcattcatcggatcaaggccacggcgtagatgattgatgtacagctctttgtttccccctccgccagggatgaggccgacacctgattcaacaaggcccatataggcttcgcttgccgcttgagtacgcgccgcaggcaggcatacttccgttcctccgccgagcgtcatgccaaatggcgcggcgacgaccggtttcgcactgtatttgatcttcatcatcgtctcctgaaaacggcggatcacaaaatcaacttccaaaaagttgtcatcttggacttccattaagatcatggcgagattcgcgccgacgcagaaatttttcccttgattgccgatgacaagccccttgtaattccgttctgtttcctctaatcctttgtggatcatttgaatgatatcaaggccgatcgcattgcttttcgaatgaaattcaagaagggccacatcatctccaaggtcaatcaggcttgctccgctgtttttcgcaatcacgccttttgtttctttaagtgcttgtaaatgaattcgttttttgttttctttcacagctctgtattcgccgcggtcataataaaataccgttccgttctctttgatgtagaaggtttcatttcctttgtccagcatctcttttatccagccaggcatatctgctccaagctgctcaagcttttccgctgactgcttgaggccgatggcgtcccacatctcaaaaggtcccagttcccagccgaatccccacttcatggcttggtcaatcgcatgaatatcatcggcaatctcgccaagcagctcggctgagtaaagcagggtttgagatgtgatattccacagcaatcggccggctctgtcatccgaataaataagcgctttcattttggcttttgtcccttttgcctgttttgccgcttcaagtgccggtgttttcatttttgtccgctcgccgtaagtaagcgtcactgggtcaagctcataaatcgtttttccttcttttttataaaagccttggccggccttacttccgatccaccctttttccagcatatcgttcatgaagcttggaaggcgaaacacttctttttcatcgccatcagctttgtcatacacatttcgggcaacgtgggcgaatgtatcgagaccgaccacatcaagcgttctaaaggtagcgcttttcggcctgccgatcagcggtcctgtgatcgaatcaacctccccgacctgatagccgcctttcagcatttcttggactgtcacgagaagcccgtacgtcccgatgcggtttgcgataaagttcggtgtgtcctttgctgtaacaacacctttcccgaggacattttctccgaaagctgtcataaactttaaaatatcaggatccgtttccttaatcggaatgatctccagcagctttaaatagcgtgcgggattaaaaaaatgcgttccgagaaaatgggctttaaaatcatccgaccggccttcagccatttcctgcactgatatgccggatgtgttgcttgagacgatgcttccagtctttcgatgttcatccacaagagcgaaaattttctttttgacttcaaggttttcgacaacgacctcaataatccaatctgcttctttcagtttttctgcatcatcctccagattgcccggtgtaatataggaggtatttttcgctgatgtgaggggagcgggcttttgtttcagcagttttttcaccgcctgccggctcagcctgctgcgcacctccggactgtccttcgtcagcccccttttttcctcttcctttgtcaaatcgttcggcacaatatctagcagcaggacaggtattccgatgttagccaaatgcgccgcaatcccggagcccattacccccgatcctaaaacggctgccttccgaatgtgtttgtgcatgagatatcccccttgaacattgaatgaatagtcattcattttttgaccaaaaaaaatgaaacccgtttcttctttcatcttaaaagatttccggttcgacttcaatagctaatttgttatttttttgtatgaagcctataaaagtcgggcaacttaagcccggaggtgaagggaatggtacgagagaaaaaaaatccgtcttcagcggcagtcagcgcggcgagcgtaaagggagatgccggtccgactcagcattacggcggcggaaaacggacaagtcaaaatcagcagtataaaaaacataacatgggacaatcataatgcagctgcttcccgcggctgctttcactttttcaaaattccttttaacacaaacgctgcattggcaggccgttcggcaattcttctcataaagtagctgaaccagtccgttccatatgggacatacacacgcattctgtagccttccttggcgagttccttctgacgctccggcctgatgccgtatagcatttgaaactcaaattgcgatgcggggatttgatgttcggcgacgagctgtttcgtaaatgcaatgatgtcatcgtcatgtgtggcgacagccgtgtagttcccgcttaacaactgcagctttattaagctctgaaaatgaaggtccgtgcctcttttgtcgggaaacgctacagccgcagattctttataagcgccttttacaagtctgagattcggctttaagtcccgcatctttctgatatcttctgccgcccggtacaaatacgcctgaatgaccgtgccgagcttctcaaattcctgtttgcattgcctgtaaatagaaagtgtctgttcataatgagaatagtcttccatatcaatggtcacagcaacatcatattgcttcgcaacggaaagaatggcgcgcaaatgagtaagagcaagttcttctgaaagatcgagcccgattgaggtcagcttaagtgaaagctctgaattcaattgatgttcggcaatggcttgaatggctttcttgcattcctctgcgacttggtttgcttctttttccgaagctgcatactcgcctaaataatcaattgttgcacacaaaccggatctgtttagccttttgacggtcttaaccgccgattcaatcgtatcccctgcgacaaaccttcgtgctccaagccgcgttccgtatgcttttgcgaacttggtaagtgttttattttgagataagaataaaaacacatgtctcaacatccgactccctcccgccgtcatcttcaaaacacctgtatataactcccagtctgaaggaaactataaaatgaacagaaaccaaaggaggatcacaatggataatcagcagcaatctcaaatgccgccttccgttatttcgacaaaggatcatttgtatctcaatgacatgctgaactggaatttgctcgcgatgaaaaaagcgcatttcatggcgcagcagtgccaggatcaaacgttaaagcaagaactcgaccgcgtcggacacatgcatcatgatcactatcaaagaatattaaagcacctgcagccaggccagcagcagtccggctacatccaataaggaggcgccagaatgaatcagcaaaatcaaaaaatcagcaacccgcagacacctgtaccgacaacatcggaaatgaatgacagagatttcgtcaacgaattgctgacaaccgaaaaatacatgacaacagcttattgcactgccttgcacgaattcagccacgagtctctttatcaggatattcaatccatttttgatgagtcacaaaaagcgcaaagaaaactatatgatctcatgttccaatatggatggtattctgttgaagcggaggattcacaaaagctgcagcagtcctatcaaaaattccagcagaccattcagcagcagtctccttatcagcaataacaacattagtaaaaaggatacgatgttctttcgggcatctatcctttttttgtgtaaaatcagttgacttttcatttacgcttatttatatttaataagcattaactattttgtcattaaaatatatatacagtgtatgtaacagaggggaaatgaatatgaagagtgcggatcagttaatgtccgatattcaattatcgcttcaggcgctctttcaaaagatacagcctgaaatgctggaaagcatggagaaacaaggtgtcaccccagcgcagctgtttgtgctggccagcctaaagaaacacggcagcctcaaagtttctgaaattgccgagcgtatggaggtgaagccaagcgcggtgacgctgatggcagatcgccttgaacaaaaaaatcttatcgccagaacacacaacacaaaagacaggcgagtgattgatctcagtcttactgacgaaggagacagaaagttcgaggaggttttggcaggcagaaaggccattatggcgcgctatctttcctttttgacggaggaggagatgctgcaggcggcgcatattactgcaaagctcgcacaagcagcagaaacggatgaaaagcaaaacatgaaaagaggaaacggatgaaaatgagtaaagaaggcaaacaatcaaaacgaacgttattaataacaggcttaattattgccatgtttttttcagcccttgacggtaccattgtcggaacggccatgccgaaaattgtcggtgatctgggcggtttgagcatgatgacctggctgacaactgcatatttgttaacatcaacaaccattgttccaattgccggtaaactggctgatttattgggacgccgcattgtctatgtatcaggtttgattatttttatggccgcttctgctttgtgcggaatggccaacaacatgacggaattgattatcttccgtggactgcagggcatcggcggaggcatcatgatgccgatggcgatgattgtcatcggtgacttgttcacaggaaaacagcgtgctaaattccaaggtgtctttggcgcaatttacgggctggcttcagtgattgggccgcaaatcggcggctggattgtagactcgttaaactggaaatgggttttctatattaacctgccagtcggaattattgcggttatttttattgccagaggattacagggacgccagcagactggtccgatcaacttcgatatcgctggtattttcacaatgattgtcggtgtggtcagcctcctgctcgccttaagctttggcggaaaagattatgcatgggattcatggcagattcttgggttgttcgctctcgcactgatcggcattgtcagctttatcatcgtagaatcaaaagcaaaagagccaatcctgccaatgtatttatttaaaaacagaacatttacatttctaaacttgatcggcttctttatgagtatcggtatgtttggcgccattacgtttgttcctttctttatgcagggaattgtcggtgtaagtgcgtctgaatcgggtacaattatgacaccgatgatgatttctatgattattacaagtatcatcggcggacagcttgtttataaaatcgggattaaaccgcaaatcattgcaggcatgctggttatggccagcggattcctgctgttaacgaccttggatctcgacacgagcaagcttgtcgctacatcttttatggcgattattggtctgggaatgggtcttgttatgccgattctgacattggctttacaggaaagcttttcgaaggaggagctgggagttgtcacttcatccagccaattcttccgttctatcggcggaacatttggcattaccatgctgggagccgtaatgaatgcgagatcaggaaatctattaacagataaattggtgccatatttagactctcttccggcacaggcaagctcgtttgccgcccagctaaagggtatgattgatacaaatccgcaagggctgctgcaatcactgttcagtccggacgcagtcaaacaaatccctgcggctttctcatcccatattgtgccgattttaaaaacatcgttgatggattcgctccacagcgtgttttatacaggcctgatctttatcgcagtcggagccgtattcaccttgttcttaaaacctatcaagctatcaaataagaaaacggaagaccaacaagaaaaagagaaggcggcaaaagccgttgaatcaccttcccattaatagagcaccccgcgggtatcaatccgcggggttttttattcaatcatctgggctcttccatttccgaaagaccaatcctcagcctgatttccggccagcatgataaacacatcttcttttcttacaccaagctcggaatgaatccggctcgcgattgagcggtaaagtgcttttttctgttcagttgttcttgactgtttcagtgtaaaatgaatgtatatcagttcatcagtacgctcgacttggagataaaatggatcataaaaaaattcgcttttttcatattgtctgatgacttggaaatagtcatcttccggcacattgatttcttcaatcatcgattggtggatagtcctgctcagtttttgaagccacacttcgcttcttcccgaccgtaaatgaatctgtacaaatggcatctccccgcatccctttctttacagcgtctgtccgctgtcaattgtgataatttggcctgtgagtgattcctgttcaattagtgaacaaatcaatttggcaacatcatctggttcagcaatacactgcagcggcaaagagccgatcatgcttttcattttttcttcccgtccggcccaccatctcgttgccacagctcctggtgctacaccgctcactctgatttcaggcgctaaggcgtgggccaatgatttcgttaaaccgtgcaccgctgattttgatactgcgtaaggcatagatgagccgacaccagttatccctgcgatgctgccgacgtttacgatcgccccggccttgcttttcttcatgaacggaaccactgcccgcgcgcagaaaaacatccctttcacattgacggcatacagctcatcccatatgtcttctgtcgcagcctcaagattatccattagaatatgccgtgtaatgctggcattgttgactaaaacatcaatcgggccgtatgttttcacgattgtttgaaccatatcctgcacgtcgctgtttttggatacatctgcttggatggcgaaggcttgcccgccagcttttcgaatcttttccactgtttcctccgcttctgattgcgagcgtgaataattcaccgccacaatcgccccgcgctttgccaattccatactggctgcttttccagttcctgtgccgccccccgttacgagagctattttgttcaagacattcattgccgccactccttgctgttgactaaagtatatttctgattccattgtaatccagctttgatgttacgtataatgattgttaaagatactagatatcacttagattgatagcaaacgaacggaggagttcaaaatggaaagcggagatttacgtgtgtttcaaatggtagctcgtgaaggaaccattacgaaagcagccctgcagcttggctatgtacaatcgaatgtcacggccagaattcagcaattggaagctgagctgggtaccacactgtttttgcgccataatcggggcatgacactttctgcaagcggaaaattgctgctggactacgcaaataaaattatcggcctgcttgatgaagcgtctaaagcgctctcatcctccgcagaaccaagcgggccgcttatgatcggctccactcagacaaccgccgcggtaaggcttccaaagctcctggcatcttattatgaagaacatccaaacgtccagctatctttaacaacaggacatacgcaatttctccttgataaagttcttcgttatgaattggatggcgcgtttatcggatgcgaatgccatcatcctgagctcgaatcctatcctgcgtttgaggaagaaccagtagttgtttcggctgcctccgtgcccgatgttgaggaagccatcacaaagccgattctcgtttacagcacaggctgttcgtatcgagaaacacttgaaaaatggctgcgctccgtcggtgtcacacagccggtcattatggaatttgggacgcttgaagcaattatcggcggggttacagcaggtcttggcatctcgttgctgccaagaacggttgtgcagaaacatgaagcagaaggatcaattcgattgtacccgctgcctgaagcgctcagccagatgaaaacagagtttattgttcgaaaagattcgtttatcagcagcgcgctgagaacctttatggattcctttacgccagataaaacggctgaatcacaaaaaagcagtctgctataatgtacagactgctttttggctattgtttgtttcgatgcgcttcatttaattccttaatatgctgaatgatctctttaatgccctgctttgcgtcggggtatgtcgcattccaatgcttagcgagcggtggcatgctcttggctatatgcgtgtacaaaatccattgcttcacttcttcttttagctcatcgtttgtctcaccaagcagaagctcagtatacttctccagcaatccatccagctgctcctgaagtttttgttccatttgccatcttcctttcgaaaaaacagcaaggagctttctcaattgaaagctccttcgctgcgttatttatccatgtgatgtgaaagccgcttcctggacaatgcatctgcccctgccatgaggaatgcaaagaggcgttccgaagagcgggtcctgtgtaacctgacagttcatagaaaacacattttgcacaagatcacaagtgatgacctcttccggacggccttctgcataaatccgtttatcttttatggccacaagatgatgcgcatagcggcacgccaagtttaagtcatggagaaccataacaatcgtccggtcttccttttcattcagctcaaacagcaaatcaagaatttcaatttgatgcgtcatgtctaaatacgtcgtcggctcgtcaagaaggatgatatccgtttcctgggcaagcgtcatcgcaatccaagcccgctggcgctgtccgcctgacaaagaatcaacggcacggtcagccatgtcctcaagctttgttgctttaagcgctctctcaactgcttcctcatcctcttttgaccactgcttcagccagttttggtaaggatatcttccttgcttcaccagctgatgcaccgtcagcccctctggagccgaaggaccttggggcaggattgcgagctcttttgcgacttccttcgtcggaagcttggcaatggctcttccttccagcagcactgaaccgcctctcggcttcatcaggcgcgctaatgaacgtaaaagtgtcgattttccgcagccattgctgccaataaatacggtaatttcacctttgggaattgttaaattcaactcatcaataataacggcatccccgtatcctaagctcagcgtttctgtagaaattgcactcatacccataaccgctcctttttgctggcttttagcagcactatgtattgcacgttttctatatacatgcttttaagtcaattgtcatcaatgcaagtgattccgatattcagccatttgatatggtcatatatccctcattgtagcagaaaacactgactttgaaaatcattttcaattagttttatggacataattgacgtttatgggttttttatcacaagattacttcttgatttctctgatggagccgtccttcagtttcaattttaaatcgatatgatcataatgactgtccagattaaatgctgccagcacactgtgtatcacttctgtttcagccatttggtctgtcacggaaagctcgctcaaaatcattttcatctcatccagtgcttcttctccctcctgatcgacaccggagagcttatcctgtatttccgctttttcctgagtcccgttctttgtatagattccttcataacggttatgctcaccatccccgtagctcacacgaagcgaaaaattactgtagggaacggacttcagctgggtgacggctgtattttctccttctgcctgctgctggtcttcattgaaacggcagcccgcaatcagaaccactgcgagacatacagccccggctgctctgatcaaatgcatatgtttcccccctgtaggattccatttattttaggtatatccagagaatgaaatcctcattcagagaagaattgaaaaagccggggcatttaacgccacggctttttctttaagattcggtcatttgtaaaaaggtttcggcgtcacgcacagccagcttgatggcattctcccagaaatcgcgctttgtgatgtcagcgcccaaatgcttcatcgccaaatcctccactgtcatagaagccgtatcgcgcaatagcgccatatacttctcttcgaatgcatttttttcttcaagcgccagcgcgtaaatgccaagagaaaacaggtagccgaatgtataagggaaattgtaaaacggcaccctcgtgatgtgaaaatgaagctttgatgcccaaaaaagcggatgatattcttctaacgcattgcagtatgcctctctttgcgcctcttccatcagctcattcaagcggctggccggtaccactccccgctttcgttcctcgtagaatctcgtttcaaatagaaatcttgcgtgaatgttcatgaagaacgcaacacttctttgcactttatcctccagaagaacaagcttttcttccctcgtctcggcctgctggacagtcgcgtccgcgactatcatctctgcaaacgttgaagctgtttctgcaacattcatggcataggagcggtttaacggcctgacgtcgagcattgcttcctgatggaacgcgtgcccgagttcatgcgcaagagtagagacatttgaggcgctgcccgaaaatgtcatgaaaatccgggattccccgctgtcaggaaaactggtgcaaaagccgccgactctttttccactcctgtcttccgcctcaatccagccgtcccgaaacgctttttcagtgaatgaggacagctttttgccaaacgttgaaaactggctggtaatgatatttgcggcttcatcatacgaataggcctttccgttagaaccgatcggcgcctcaacatcgtaccagctaagcttttcaaggccgagcatggatgctttccggttcaaaaactgaacgaacggctgcttgttttcagtgatgacctgccacatcgtatcaagtgtttcttttttcatcctgttaatttgcagcggttccttcaggacattctcccagccgcgcgctttataggtttcaagccggaatcccgccaaatgattcagcgtgctgctgaaaatatcttgcttgctctcccaagcttggcggaaacgttcatatactgtttttctgacagtacggtcttgatggtccatcatattctccgcctgaccgacagacaattgcttgttttcaccgttttcctcataggggatcgtcattttcccgacaaccatattgtagaagtcactccaagcgtgatatccgtccacggcaaggttcccgatcagtttttctttaccggggctaagcttttcggcaaccctctgtcttctttcatttaatatgtaagaaacatcgcgcaatcccggttttgttaacaacctattccacacttcttgatcaatgtccacaagtttatgatctaatgtaacgagcgacgattgaaaatctgcggaaagccggttcatgagtgcctgatgctctatagccttttgatcattgatattctgggcctgaaggcaggcaacaaacgcgccggcctgctgaagcttgacggatgtctgttcgaataaatcaagcaacgcggtcagtccttcagcctcttcaggcgattcaggcacctgaaacgcatcagtcctgtcttgaaatgcacgcagactttgtgacagcttctcaatataacctttgaattcttccgattggctcccgcccttaaaaaatgaatcaagatcccatctttggcctaccccttccaacgccatttcacaaaacccctttccttctttcgttctattatagaacaattctgaattgttgtataaaaatttctttttacaggcgtcatctcctgttcaggatagtacaatagctgtagcagtttaataggagggttaggatgaataaaaaaatagcaatcgtaacgggagcctccagcggcttcggtctgctggcagctgtaaagcttgcccgatcatttttcgtgatagccacatcaagacagcctgaaaaagcggaacagctgcgggaattggctgcagcacacaatgtgtctgattctattcacattacagctctcgatgtcaccgatgaacaatctatagtctcattcggaaaagccgttagtgcttacgccccgatcgacttactcgttaacaacgccggaacggcttatggaggttttgtcgaggatgtgccgatggaacatttcagacaacaatttgaaacgaatgtcttcggtgtgatccatgtgacaaaaaccgtgctgccttacataagaaagcatggcggcgcaaagattataaacgtgagcagcatcagcggactgaccggattcccagcgctgtcgccatatgtttcttccaagcatgcattggaaggtttttctgaaagcctgcgtatcgagctgcttccgttcggtatcgaaaccgctttgatcgagccgggctcatacaagacatcgatctggtcaacgtcattatcaaattttatgtcggtgcctgctgacgattcagcctatcatcaatactataaaaagatcctttcctatgttcaaaaaaacggagaagaaagcggagatccccaagaggttgccgacctcatttatcaattggcaacaaaacagcacataaagaatttgcgatacccgatcggaaaaggcatcaagctcaccctgctattccgatcgctttttccttggtctgcgtgggagtctatcctgaagaaaaagctattcaaataacctaaattataattattataatttagtattgatttttatttagtacatgatataattaaaacaacagatcacaaggaggacgttatcttatgaaaactgaaaacgcaaaaacaaatcaaacattagttgagaattcactgaacacacaattatcaaactggtttcttttatactctaagctccaccgtttccattggtatgtgaaagggcctcatttctttacattgcacgagaaatttgaagaactttatgaccatgcggctgaaacagtggataccatcgctgagcgcctgctggcgattggcggacagcctgttgccacagtgaaagaatacactgagcatgcatctatcacagacggcggaaacgaaacatcagcatcagaaatggtacaagcattggtaaacgactacaaacaaatcagcagcgaatctaaattcgtgatcggcctggctgaagaaaatcaagacaatgcgacagcggacttgtttgtcggattaattgaagaagttgaaaaacaagtgtggatgctttcctcttatttagggtaacaaaaaagctgaaccttaatcgggttcagctttttgttttttcttagcttgaactgctttctgtctgcttggtcagtgttgcgttcaacgttttcgtttttccctttcgcagcacttggattgttgttttatctccgacttttaagtctttgtaaaggatctgacggatatccgcactgctttccacgtctttaccgtttagtttgacaatgacatcctcagatttaatacctgctttttctgccggcgaatttgcttgaacttcttttacataaacacctttgcccaattgatctccaaacaggccgagcgtattttcctgataggtttcaggaacttgtgacatgtcaatcatctgcacgcctaaaaacggacggtccaccttcccgttttgcagcagctggtcaacaatcggctcgacatcattgcttgggatcgcaaatccaagtgattccacgccgctttcgctcaccttcaagctgttgatgccgatgacctggccgcttgcattgattaatgggcctccgctgttccccggattgatcgctgcatcggtttgcagcacgttcatttccaccgtcccctgtgttgtatccacatcaattgtccggttcagtccgctaatgataccttgtgtcactgtaccggaaaactgctgtccgagcgggttaccgatagcgattaccttttcgcccgtgcgcagctgtgaagagtcaccaaagctcgccacttttttgacgttcttgctgctgatttccaaaactgccaaatcagtaatggtatcactgccgacaagcttggcagtttcagtttctccgttgtatagcgtaacagtcagcttgttcgcgccttcaacgacatggttgtttgtaatgatatacgctttattgctgtcttttttgaaaataacacctgacccggttccgctttcactttctgagctggagcctcctcccgtgccgaatgtgttattttgagaggtttggatatttgagattccgacaatcgtaggctctaaatcctctaccatatcagcgatgtttgatgcgttcgttatcggcgccgttgtaaaattatcagactgcacctgtttatttgcggaagcggtctcggtcgcctgattttggtctgacggcagataaggcgcgatgccaagcatgaggcccccgccgataataccgcctaaaatcgggctcagccatgcggctctccttttcttttcttttttcacagccgtttcttgcttttccatttctagtgcagaagccgtttcctgccgtcccgcttcatacgacacaggcgcgtcaagcaattcttgttcagaatgtccaatcagcttctggttttctgtattctgctgttctgtatgtgaaggttctgtttgatgttgatcgttttggtcatcacgtcgataatccatgttcttgcactcctttaacggttattcatttatcgttacatattcatcgcatgtacaagttcaattgtcccaataatgaggagaaaagcaaagcaccaaaatagaatatgtttgatcatcttacatcttcctcgctctttttctcttcctttcttcccttaaccatatcataaacaaacattgtgggataaaaatgaaaagaatatgtgaaattatgaaaattgcctgccgtatgttaaaactagtttataatgacgttgaaaggatgtgaagagccttgtcatacaccatttatctagttgaagatgaggataacctgaatgaactgctgacgaagtatttagagaatgagggctggaacattacatcttttacgaaaggtgaagacgccagaaagaaaatgacaccgtctccccacctatggattctcgatatcatgctgccggataccgacggctatacattaataaaagaaatcaaggcgaaagatcctgacgtgccggtcatttttatttccgcccgagatgcggatattgacagagtgcttggcttagagcttggcagcaatgactacatttcaaagccgtttctgccgcgggagctgattatccgtgtgcaaaagctgctgcagctcgtatataaggaagctcctcctgtccaaaaaaatgaaattgccgtctcctcgtatcgggtcgctgaagacgcccgcgaggtctatgacgaaaacgggaatatcatcaatttgacgtcaaaggaatttgatctgctgctattatttatccatcataaagggcatccatactctcgtgaggatatcctcctaaaagtgtggggacatgactacttcggaacagaccgggtcgttgatgatctcgtccggagactgcgcagaaagatgcctgaattgaaggtggagacgatttacggtttcggctacaggatgatgtcatcatgaaaaacaagccgctcgcgtttcagatatgggttgtcatatccggcatcctgttagcgatatcgattttactgcttgtattattttcaaacacgctgcgagattttttcactaatgaaacgtatacgacgattgaaaatgagcagcatgttctgacagagtaccgcctgccaggttcgattgaaaggcgctattacagcgaggaagcgacggcgccgacaactgtccgctccgtacagcacgtgctccttcctgaaaatgaagaggcttcttcagacaaggatttaagcattctgtcatcttcatttatccacaaggtgtacaagctggctgataagcaggaagctaaaaagaaacgttacagcgccgacgtcaatggagagaaagtgttttttgtcattaaaaagggactttccgtcaatggacaatcagcgatgatgctctcttacgcgcttgattcttatcgggacgatttggcctataccttgttcaaacagcttctgtttattatagctgtcgtcattttattaagctggattccggctatttggcttgcaaagtatttatcaaggcctcttgtatcatttgaaaaacacgtcaaacggatttctgaacaggattgggatgacccagtaaaagtggaccggaaagatgaaatcggcaaattgggccataccatcgaagagatgcgccaaaagcttgtgcaaaaggatgaaacagaaagaactctattgcaaaatatctctcatgatttaaaaacgccggtcatggtcatcagaggctatacacaatcaattaaagacgggatttttcctaaaggagaccttgaaaacactgtagatgttattgaatgcgaagctcttaagctggagaaaaaaataaaggatttattatatttaacgaagctggattatttagcgaagcaaaaagtgcagcacgacatgttcagtattgtggaagtgacagaagaagtcatcgaacgattgaagtgggcgcggaaagaactatcgtgggaaattgatgtagaagaggatattttgatgccgggcgatccggagcaatggaacaaactcctcgaaaacattctggaaaatcaaatccgctatgctgagacaaaaatagaaatcagcatgaaacaagatgatcgaaatatcgtgatcaccattaaaaatgacggtccgcatattgaagatgagatgctctccagcctctatgagccttttaataaagggaagaaaggcgaattcggcattggtctaagcatcgtaaaacgaattttaactcttcataaggcatctatctcaattgaaaatgacaaaacgggtgtaacataccgcatagcagtgccaaaatagactgtagatgttttgcagtctatttttttatgtgaaagaatagccgttaaaatctctgtaatttgttttgagcggctgtttgcattgatgaacccattttttctctgacaaggtctgcttcggatatttgactttctccactttgattcctctgtttcgcaagcggctgatcatttcgtccaattctctcattctagattcaccctttcgcttgagctttgaccattcggtcatctcaatttataatataaataatacatgataaaaaaacaagttacaataaggttaattttataacagacggtgtgactatatggtcatatcctagcaggcctccgggctccgaaagggtggaaccattgaaggaaaaagaaaaactgattattgaaacagccttaaaactatttgcccaaaaaggatacaactcaacatcagtccaggaaatcgcaaaagaatgcaaaatatctaaaggcgctttttatatttattttccttcgaaagaagcgcttcttctctctatgctgaactactattatgataaaacgtttacccgaattttaaatattaaaacgaagggcgacagccccagaacggcttaccgtaaacagctgaccgtcctctatgaaaacattcttgaacacaaagattttatcagcatgcagttgaaggagggttctctgccttacacagaagaagtggagcaatgcgcaaaaaaaatccgccagtcctcacttcaatttcatatcgacagcctgctgaacatctatggaaaaaaagcggaaccctacactgctgagctttgttttttaatagagggcatcagccagatttacctggaatgcatgattttgctcgggtacactgtgaagccgtctcaattagctgatatcattatgaatcgaattgatgatatggtaaaaggcatgtctgaacgaaacgataagcctttcatcacattggaagaggcgagctctttattcgggcctcttacgcacggacggcctgacccgctgactgaatcaattgtgaaaagcctacgtgacaaaattaacagcttaaacacaaactcctctcttgaattatcggagagcttggacatacttgaagcagaaatgaagaaaaaaacaccgaagctggcgatcataaaaggaatgattcataatctgacggagtctgaagctctcgccaaagatgcggagcagcttaaatatttattaaaacagcaacatatttagaagaacggctgcttaaaaagcagccgttctttctttctattacgcctttggttttaccatgtcttccggcttaaccatttcgttaaattgctcctctgtcagcaattcaagcttcaaagctgcttctttgagcgtcaatccctctttatgggcaagcttggcgattttcgccgcgttttcataaccgatatgcgggttcagcgccgtaacaagcattaatgaatttgacaggttttcctgaatggtttctttattaggctcaataccgacagcacatttatcatggaatgaattcatgccgtcactgagcagctgcacagattgcaggaagttgtaaataataacaggcttaaacacgttcagttcaaagttcccctgactcgccgcaaagccgattgtcgcatcgttccccatgatttgcgctgcgatcattgttaacgcttcgctttgtgtcgggttgactttaccaggcataatagagcttcccggctcattttcaggaatgacgatctccccgatgccgcagcggggtccgcttgcgagccatctgacatcgttcgcgattttcattaagtcagccgcaagcgcttttaatgcgccatgcgcataagtgatttcgtcatggcttgtcagcgcgtggaatttattcggtgaactgctgaacgtttggccggtcagcttagtgatctcttctgagacaagctctccaaactctgggtgggcgttgatacccgttccgacagccgttccaccaattgcaagcgcacgcattttatctgtcgcttccaaaatcatttccttcgaacggtccagcatgtgaacccatccgctgatttcctgtccgagggtcagtggcgtagcatcctgaagatgcgtgcgtccgattttgacaatatcattgtatgcttttgctttttcatccagtgtattgcgaagctgatcaagcgccggcacaagctgctcgtaaacagccaaaacagcggcaacatgcatcgcagtcgggaatgtgtcgtttgagctttggcttcggttcacgtcatcatttggatgaatcgtttgatcagagttcttctcttttaataaagcagtcgcacggttggctaccacttcgttcatgttcatattgctttgtgtgccgcttccggtctgccatacgacaagcgggaagttgtcatcgtacttgcctttgagcacatcatcacaaaccgctgcaatcgcttctgctttttcagcgtccagattgccgaggcgtttattagctagagcagtgcttcgttttaaaattgcaaacgccttcacaacacgcatcggcattttttcagaaccgatcttaaagttctccttgcttcgctgtgtttgggcgccccaaaatttatcagcaggaacttttacttctcccatggtgtctcgttcaattctgtattccatttatgtatccctccataacggttgcttcaatagatcataattcgccaatgacacaaaaaatcctttttatttttcgatcttggcagattttaattttaattcaagatatacgcgggaatcctttgaatatttgtattttggattcgtcctgccgtactcctttgatgtataagagacatcataatgctgttcaaatgatctaatgagctgttcaatttcttcttgttttccagctagccttacctgtgccacttcgtctcctccgctttcataaaaaaacttactccatgaaatactctaacacagtatatcatttttttaacaggaaaagataacctctactaaggttttggataagaggtgacctcattggaacaaacagagtttaaggaatatatacacgataatttagcattggtgctgccaaaattaaaagaaaacgatgatctggtgaaaaacaaaaaaatgcttgcgaacggactggttttttactatctctatttcagtgaactgactgatgagaataaggtgtcagaagccattaaaactttaattaaagatgaggagaccttaacgcttgaccaggtcaaaaaacgccttgaccagcttgacgcaagacctattgaaaccgcaaaaaaaacgattgaatcgattctcaacggcaattgtgctgtgtttatcaacggattggataaagcctatattctgaccacaggaaagaaaaaaacaagaagcctgacagagccgacaactgaaaaagtggtacgcggcccaaaagttgcgtttgtagaggatattgatacaaatctcgctctgatcagacaaagaacctctcatccgaaattgatcaccaaaaaaatcatgatcggcgaaaacaagctgaagcccgcagccattatgtacattgagggcaaagcgaaaaagtccgtcataaaagaagtgaaggcgcggcttaaaaatatccagctggaagatatccaggacagcggaacgctcgaggaactcattgaagataataaatattcaccatttccgcagattcaaaatacggaaagacctgacaaagtatcttcagccctgtttaacggccgtgtggcaattttggtcgacagttcaccatttgtgctgctggtgccggtttctctcggcatcctgatgcaatccccggatgactactatgaacgctggatttcagcatctcttatccggtcgctgcgctttgcttctatcttcatcaccttgtttttgtcatcgatttatattgcacttgtttccttccatcaggggctgctgccgaccgcactcgccgtcacgatttcggcgaacagggaaaacgtgccgttccctccgatatttgaagccctgctgatggaagtcaccatcgagctgctaagggaagccggactgcgactccccaatccgctcggacagacgatcggcctcgttgggggcgtggtcatcggacaggctgctgtagaagcgaatctcgtcagttcgattatggtcattgtcgtcagtgtcattgccctggcatcctttaccgttcctcaatacggaatgggtctgtctttccgggtgctgcgttttatttcgatgttttccgccgctattttagggctgtacggcattattttatttatgcttgtcgtttatacgcacttaacgagacaaacgagctttgggtctccgtatttttcgccaaacggattctttagcctgaaaaatacggatgactccattatccgtctcccaattaaaaacaaaccaaaagaggcgaataatccaaatgagccaaaaacagactccactgaaacttaatacctttcaaggtatttctattgttgcaaatacaatgcttggggccggacttttaacattgccgcgagcgctgaccactaaggctaatacgcctgacggctggatcacgctgatattagaaggtttcatttttattttcttcatttatttaaacacgctcattcagaaaaaacatcaatacccttcactctttgaatatttgaaggaagggcttgggaaatggatcggcagcatcatcggccttttgatctgcggctatttcctcggcgtagccagcttcgagacccgggcaatggctgaaatggtgaagtttttcctgttggagagaaccccaattcaagtcattattttaacgtttatttgctgcggtatttatttaatcgttgggggcttaagtgatgtgtcgcggctgtttcccttttatttaacggtaaccattattattttgctgattgtgttcgggatcagttttaaaatttttgatatcgataatttgcgtcctgttttaggcgaaggccttggacccattgcaaactcccttaccgtcgtttccatctcttttttaggaatggaagtgatgctgtttcttcctgaacatatgaagaaaaagaaatacacgttcagatatgcgtctttaggatttctgattccgattatcttatatatccttacgtatattattgttgtcggagctttgaccgctcccgaggtaaaaacgctgatttggccgactatttctctctttcagtccttcgagcttaaaggcatatttattgaacggtttgaatcgtttttactggtggtctggatcatccagtttttcaccacatttgtcatttacggatactttgccgctaacgggctaaagaagacatttggattatcgactaaaacaagcatggtgattatcggcataacggtcttttatttttctctctggccggatgacgccaatcaagtcatgatgtatagcgattatcttggctatatttttgtctccctgtttctgcttccgttcattctctttttcattgtagctctcaagaggaggattacagcaaaatgaaaatccggattttatgtatgtttatatgcaccctattgctgtccggatgctgggacagtgagaatatcgaggaattaagcttagtgatcggagtagggctagacaagcctgacgatgaaaatttagagctgacacagcaaattctcgtgccgaaaaaaatcagcgccaaggagggctcttcatctgatccgacacagctttctatcacaaagggtgaaactgtccatcaaatgatgagaacctctgcattaaagcataatcctacgttttcacagcatttgcgtctcattctgctttccaaaagcgtgattgcggatcaaattggaatggacgcgatcattaaccagtttgtcagagacaacggaacaaggaggagttcctacgtctttatcaccaactgccgaactaaggatatatttaaaatgaatgatgaaggcgaacccgcatccaacgtgatatatgatctgacagagaataataaggtgacgatcagaatgatggagccagttacattgggggagatctcagaacacttaacctctgacgattcattcctcatccctcatgtcggtaaggaaaacggaaagctcgcgataaacggagcctctatcataaaaaataaattatggcacggcgatctcaccccgattgaggttcaaaatatcaacttattttcaggcactgtcgagggaggcgtcattgacttgaagcgcgatggccatctcttttcttatgaagtatattcaagcaatcggaagatcaagacggcctataaggacggaaagttcaaattcaccgtcacccgcactattgaaggtcgtctatctgaggactggaatcctagtgaagattcgtttaaggattcatatattaaaagcattgaaaagacagtcgaaaaacaagtacacaaaacagtaacgacatttattacagagaaactgcagaaagagatcaaagcggatgtgaccggattgggaaaccaagtcagaattcattatcctcaaaagtggaaaaagatctcaagaaaatgggatgatgattatttcagcaatgcggaaatagactaccgggtcaatgtgattgtcagagacttcggaacgaaaggcgcaaacaaataacagccgcctaattcacgagatgatttcggtgtgcgtacaccgccgcctgcgtccggtcactgacatccagctttgataaaatattggtaatatgtgttttgactgttttaatcgtaataaacagttcctcgcctatttctttgtttgtctttccttctgcgatcaggaagagtatttcgagctcccgtttcgtaagcgattcatgagggagcgcgttttcacctgagtggcgcagcctggataatacttttcccgccacttttgactccagcttcggctctcccttgcttgcggcgcggatggcatcggcgatttctgccgcttttgaggttttcaatagatagctgagcgcgccagcttcaataaccgggtacactttgtcatcatcaatgaagctagtgagcacaataattttcgggtcagaaagctcccggcaaatttgctttgtagcttgaatgccatccatgccctccatgacaaggtccattaaaatgacatcaggcgacagttccacagcaagccgaacaccttcgctgccgtccgatgcttcgccgatgacttcaatatcgggctgcgcctccaaaaaagccgcgagccccattctgaccatttcatgatcatcaatcaataatactcgaatcacgttcgttctctcctttttcttccgggaaaatcgggaccttcacttcaatttgggtgccttttccttctactgaaatcacttcggcgaccccgccgatttcacttgcacgttccttcatagaattcaagccgtatgaggatgctttcacctggtccattttgaagccttttccattatcaatcaccttcagacggagctggctgttctttatgcccagaatcacggttacttttgacgcttttgaatgtctaaatacgtttgaaagggcctcctgcacgattctgaacaagtggtcttcaacacccttggatatcgctgtgtcctgtatatcccactcaatatcaatcggctgcttttttcggaactcgtccaaaagctccgtaaggccctccttcagcccttttccttcaagggtaacaggccgtaaatggagcagcagcgccctcatctcattttgggcttcgcctgccatatgctcgaccatcctgatccgcttgactgttttgtcatcagcatccttgacatgttccagcacggctgatgtcatcatcgatatggcaaagagctgctggctgaccgcatcatgaagatctctagccaatcgctggcgttcttctgagataaccgacttcttcatttgagcctgccattccgcacgttcattggaaagtttctggagggatgcgacttgaagctccacgcgcttcgccatttcgttcagctgatcagcagccaggccgatttcatcatcaccgagcggcggtatccgataagcgaaattgccgttttcaaaggttaaaatggattcaattaatgtatcaatccttgtcttcaaccggttgccgtacatataccctgaggcgaaaccgacggtcacgctgatcagaagcaaaatcaggataaacggaattccgaaccagctagatgacagcaaaacaagcggatcgagccgatagtaaaacatcataaaggaaatcaggcaggcaaaaaggagcaggctgattcccgttgtcatgcggatggcgcgccattggaggctggcaagcattttttttctcatacgtacttcacatccacatcaccgataaataaggaaacggacactttgacccggcgctttgactcgctaaaatcggttgacgcggcatataccttcgtgcttaatccgcttttcttcgagccgatcagattgatgtctcctataaaaacagccgagctgacagctacttcaaggtccgatggtacataaatatcaacgtttccaatgactccgctaatgacgattgtgctttctccctcgggaatcatcgctttagacaaatcgattttgatatcaccgataaaaccagaaacatttaaatcattcagatcaaacggctgcttcatcatttgcagctcaccgataaaaaagctgcgcatgtcgggatgttttacatcttttggcggatcatgatgttcttttttattgagattgacctgtttctcattcggttcaaatatcggcttccctttgataagcctgtagccggcgtaaattagaaatgcggcaaacgcatagccgaataaattaaaggtgatgctgaagaggtttttcaaaaatagaaacgcggcaaagatatacatgacggagccaagccaatcacgggaatattttttaaggaaatagccggcaatcagaaaaaagagcggccaaaacagcagatcgcctattccgataatttgcaaaaacatactgatgccgaataaagcaatgatcaatccgagaagctgtttttttgtcattcctggtgtccgcctcctttcttctgcctagtgctaccgtatcgctagatccccgctgtccgttttgatgtcgattggatgctggccgcttccttgcgtgcctgtgatgtgatgctgttctttatgtgctttatcagcaaatgaatacggcgaactgacgtcaccgcttgctgataaagcattgactgcaaagctgccgttttgtggaaggcttacattagcatcaccgcttgtcagcgtgacagatacgggaccggttacctttttcaatacagcattaaaatctcctgaagtcattttcacatcaagagagcctgatacatgaaccagatttgcgtcccctgaagctaaatcaatgccggctgttttggagacggtatttgaaatggaaacatcccccgatgatgccttcactttcagatcttgaatgcggacgtccgtcacgctcgtatttccgctcgcagatactgcgttcagcccggaaagcgcaagatggtcattcccggccacagacacgtcaccgcttgaggttcgtactgccagatcacctttataatcatacggaagcctgacgataagagttgaacggttaaatccattcaaaaattgaaattctttttcctttacggtcagctccagttttcttttgttttcagtaacaaataactttcctgagtctcctgaaatgcctgccgatatgtcacttcgttcttccgctataatccggacatccttgctatccgactcaatgaccatgctgtcaatgtcccgcggcgatgcgctggctgaatcggcttctgtgccatttatgaaacctaagcctgcagcaaacacatcttttacgacgacggcgaaaaaaaccagaataccggcagtgatcaacagtttgccaagcatttttttcattcggtttcatccttctcattcattctattataaaggaaaagcttgcgaattgatacgtgcggaagggaaggacttgaccgcaaatccttccccgttccgcttattcatttgccgcttgtgtctggtttgatttttgcagtgaaagtgtccgcattttttcaatctccgcttccacatcgtctgcgaattctttacgtgtaagttctgcaccggcttccgctgactttgaataattcgcgcggatttccatttcttcaatacgattttcaatacgcaaaaattcacgatacgcgctttcactgtcaattttgtcaaatgtcgtattcatatgctctttagctttcgccgcatttgcccgcgcaatcagcgcctgttttttatcctttacgtcctgaagctttgtttcaagtgcagccagctgctctttcagatcagccagctgactgtttgcctgttcataggaagctttatgctcagccgccttcccttctaaatacttcatttcagtcagcgcctttttcgccagttcttcttcacctgcgtcaaatgcgagctgtgcctgatttttccgtttgccagcaacttcagcggcttcttcatattttttcttaaattgataggcaatcgtgtgctgtttcacaattgtttgctttgcttttgcgatgtcgctttccatatcgcgtacatattgattcagcatcacctttggattctccattttatcaagtccttcatgaactgacgcaacaaacatgtctctgattctttttaataccatacctaattcctcctaatatattgatattattttttcttcaaaaattcttcccattcgtcatcaaagtgagattggtaagcagccgaagccggttcaggatcaaaagatgatacaccgttatcagctgatccgtttttcatcagcttccagccgtaatacaccatagcggccgccaacgcgattccgacgacaaacggaagtgagcagatgagcataatggctccgataccgcccacgatgattcccgtgatggtttttcccgcggcaaaccttttgattcctgcgtatgtcatcaagctcccgatggcgagcgggatgataaagccgaagcttcctcctccaaaaaagacagagatcccaaatacaattaataagaatccgcctattgttttcttgtttatcttcatgcagatcctcctttcgttttccttgtcttcatcttatacaagttggaagatatgcaaaacgaatcagagattgatttttatataagaccggagtcgtatctcgcaccggacccattggcacaaaaaaacgccatgcacgaggcatggcgttttaaaaccctttacagatgaacacttgcttccctttctttaatcaggtcggacctttctgctttggccagttttgtaaacagcaaaattccgatacccgcaataatttcgacaatcccgccgacagcgatcactttacctgagccgaaagcattagcggcatacccgcaaatgacagctccggcagggatcgaaatatttgagatcatatgtataacggcgtaaacctgcggctgatcctcactgtccacagacgtctggataatcgtatactcaggaacattaacagcactgactgcggcgccaaaggtaaaagcagcgaaaaagacgagcggcaaaaaggtattcatcccggtaataaagaaagcaaatccttcaataatgccggcagtgacgaataacaagccgtacctgtttaccttgactttcgccagcacaaaccctaataaaaacgcgcccgcggcggtggtggcctttaaaagcgagtatacgatcggctggccgtttaaatcttccgcaacgtatacggcagagagcgcttcccatggggcagccgcgaaattcataaagatacagtaaatggcgagcggatataaaatctggtgttttctgacgagcctaaagccgcgtttcagtcttccgatatatgtgcctctctgtgtaacaactgcagactctgattgagattcaaccgcagtgtacttaataaaaagaacgagaaaacccgacaccaaatagagcaccagtgcgataagcatggtataagaaggactgataaatgtaagaaaagcgccgcataatgtgacagccccgagccgaacaatttgagcggaggattgcagcacagcgtttgctttttgaatgccctgttcattgacgatttgaggaatcaaagcgatagaggcgggattgtaggcagctccagtagctgaatgcacaatcataagcgtcatgacaaaccacagcggagagaagcccgcaaaatgacatagagggataatcaaaacaatcgccgcccttgtcagatctgaaaagtacatccaaaatttcagcgtggtctgtttcataaaaggccccgtcacaggcgccagaacggcttccggcaaaaaagtgacagcaatcaataaagcagtgccgatcgcacctttgccgtcataaattaaaaaccataatattgaattaaatgcgaacatatcgccggatatcttgactattcttgagaaaaacagataattgaaatttctcttccagatgctatcactttcaattaaattcaccatccatcagagccccccgttgcctattttttacatctatttattacaatatctcatttttccatttttcagtcaataattcataaggttcattttttgtcgtaaaatgggaaattgacagagtgaaaaacaaaaaagccggcatgtatttgaacacgccggctttccttttcactttttatgattcgctgctgtttcggtcccgaaacacaatggcacttctttcatattctacatcgccaataccgcttcttgcattcacaacccgggcggcggcaaagaaataatcggacagacgattgagataacgcagcactgtttcatgaatctcctccgatttcatcagcgccaccactcttcgttctgcccgccttgtaatggtgcgtgcgatatggagaagcgaagcaccctttgatccgcctggaagaataaatttcttcagttccggcgcttctgctgtataggcatcaatgcgcgtttctaaaaaggaaacagattcttccgctagtttgtagtcttttctttctgtgacgattgccagatcgcctccgcagtcaaacagctcatgctggatggtcagcagctcggctgtcagatcttcaaagccgggctgcccggaaagctctgccaaagcaagcccgataaagctgttaagctcgtcaatcgtgccgtagctttcgacgcgtaggctgtccttgtccgttctgcccccgactaagcccgtttgtcccttatcgcctgtttttgtatatagtttcataccctgaatctcctttacagacttattcaaacaactcagcagcctcttctacacattcagccgtccctttctttatcaattggttcagccgctgttctatgttttcggattgctgagtttgagtcgcggcgatgagaatatcacctgtgcctcttccgtctcccagcactttcgtccgttctgcttcggcagccataagagctttgatgaagtattgatctgccgcatagccgttaatcaaaatccaaatcgaaaagccggtctgaacgcatatgaaaacggataactctccgtcttcatacgttcgatacacgaaacggtcaagtctttctgaagaagccatcgcacacgtttcctgcagttgaaaaccgctttctgaaagataggccataagtccttctatcggatctggctgatctggcagccgtttatggatcagcgtcctgctccacgaaaaccctgcaccgataggcgtcgaggacaatgttcgaagcgggatttccgtttgcagaagaatgtcatcacgccccgcttggagcaatgcttcaaatgggatagactgccgcttcacgctatctttttcaggctgaatcacaatcatcggtttaggtgagctttgatgaaccaaggcggtgacatctgtatcgtacaccgcctttatgctttgttctgtgacagcatattccggtttttgcttaggcccggcggtaccgtttttcataaacatgagctcatcacagtacaggcttgcggtgttcagatcatgaaaaacactgacagctgccaatccgctttctctcgtcaggcgtttgatcagatcaagcaggtctttttgataagccagatcgagaaaattagtcggctcgtccaaaaataaaatacgcggctgctgcgccaaagcttgtgccaaatacacccgctgctgttcccctccgcttagttcgcgaatcggcttttgcgcaaaatcggccactcctgtttgctccattgcttcctgtacaatggcttcatccttttcagtctgctgtctgaacagccccgtttggaatggatatctgccaaaggctacagtttcttcgacggtaaaggtgaaggcttgatccgttttttgcggcaggacagccatgatttgcgccagttccttcggtttatagtccgccagcagttttccggccagataaacgctgccttccttggccggcagcgtgcctgtcagcaagtgcaaaagcgtggtttttccgcttccattagggccgagaattccgagaaattctcctttctccactgttaagctgacattgttgattaggcggcggtccccgtatcctcccgacagcccttctgccttcatcataagcttctccccccgcggtgctgccgaattaaaataagagcgaacacaggtgctcccgccaaggacgtaatgatcccgatcggcagttcaatcggctcaatgatggttctggaaagcagatcggctaaaacgagaaaccctgcccctagcaaggcggacagcggcagtaaatgccgatggtccgttccccacaaaagccttgtgatatgcggaatcacaaggccgacaaagccgatcgtgcccgatactgccacagcgcttcccgtcaaaagagatcctgctattaatatcatcatcttcctctgctgaacgctgactccaagaagctttgctttatcttctccatatgtcatcacgttcaattcccttccgtttataatcaataaagtgattcccaaaagaaaaaacgggagaaacaaaataacatagctccagcccctcattgagacgctgccaagcagccaatgcacaatcggaagcaggttgtctcctgtcaaggcgatgataagagaaataaatgcgcccaaaaaagagttagtgatgacaccggtcaaaatgagggtggaaacagacatcgaagcatgaacgaggcggctgaagaaaaggactgccgccatcgtggccagtgccgcggctacactcacaaccgggagtgtaaactctccgatgacaggaaggtgcagacctaagaacagagtcacaacagctccgactgaagcaccggatgacacacctagcgtatagggatcagcaagtggatttttcaacaatccttgaaaagcggcccctgcaacagaaagagccgcccccacaagggcggccagcacaactctcggcagtctgatattcatcataatattagtgtacatcggatcatcagaaccgatagagccgccgaaaccttgatgccaaaagacacgaaaaacagcgggaataggaatatgcaggctgccgcaagaaattcctaagatgatgctcacggctaaaaatgagaaaccaatgatatatgcggcataacgattattccttaaacgtatccgggtaaatgctttccgcaagttcttcgaccccttcgatcagacggggaccggaacgtgtcacaagatctgggtccacatcatatacacgctgatgtttcacagcattgatttcgctccagccatcgcgtttttccacagctttcgctttcacaccgtccgttgtaacaattgcatcaggattgagttttacgatcgcctcatctgtcatttgcacccatcctgtctgatccgcagctgcgtttttagcatggatgacattcagcatttcattcataaacgtatcttttccggttgtataaatgttaggatcaggagaaacctcgataaatacgcttttctcctcgtcttttgaaatggttttcgctttttcttgaatatcctttagatctgatttcatgcttttcacgagctgatcggcttttttctccgccccgccagcttctccgatcatttcgattgatttgtacacctcggagaatgattgtgcatcattgacagtcagcactgtaatgcccgcgtccttcagctgtttgatggcatccgctgatgctgacatggaagactcatgggccagaacgagatctggttttagagaaatgactttttcaacgtttacattcatatctccgactttctcaacctttttgacttcctttggataggtatcgtttgtggtgacaccgaccactttgtcaccaaggccgagtgcgtatgtaatttctgtgttgctcggcattaatgaaacaatcttttttggctcttttttgatggttacatcttggtttgacgcatcatcaatggtgacagggaacgcttctgttttttgttttgcctttgaatccttctgatccgcaggattgccgcagcctgccagcataacagcagccagcaggagcgcagtccatatcccggctcgttttttcataatcttttcctcctaaacgaactaaaaaagcatctctacgacggtaaagatgctgtaaacaacacaaaaaagcctattgtttacacatcatctgtcctcgcagaattcgtgctgatcaaacaggcaggtatcctggctcttggcgcttggccaattacagtggcgggaccgcaccggcttttaccggtttcccttttaagccggctgttgttcacggaccggcacctatttgacattcgtatccgtttttcggagtaattatactatatgactgacaggcttgtatatgtgtcctgaatgacttttccccatattgtgtatggaagcaaaatcctcgtaaacactaaatttgatcttgtatacttaataccatcatcaatcaaaaggaatgattcttatggatttacagctaaaagacaaactcgtcttaatcaccggctcgacgtccggcatcgggaaagccgccgcaaaaagctttctgcaagagggtgcggcagtcattgtcaacggacgcaaacaggagactgtcgatcgcacgattgaagagctttctggctatggaacagtgcacggtgctgctgccgatttgtcaaaaacagatgaagcagcggcttttatcgaaaaagtaaatgaaatcggtgatatcgatatccttgtcaacaaccttggtttcttcgaggtaaaagactttgccgatgtgacagatgaagagtggaatcaatatttcgaagtgaacgtgatgagcgccgttcggacaagccgtcacttccttccaaaaatgcttgccaaaaacagcggccgcattttaaatattgcaagtgaagcaggcgtcaaaccgctgccaacgatgattccatactcaatgacaaaaacggcgctgatcagcctttcaagaggaatggctgaaatgacaaaaggcacaaatgtgacggttaactcagtgctcccgggacctacttggacagagggcgtggcatcctatatggaaggcgccgcacaagcagccggccaggatacagacacatttatcaaagactatttcaaggtcaatgagccaacctcgcttattcagcgatacgcgacagcagaagaagtcgctaacacaatcgtattcctcgcgtctgacgccgcatccgccattaacggcacggcacagcgtgtggaaggcggcattatccgttctctgtagtataaaaaaacgcatccgtgtttcggatgcgtttttttatacgtctccagcaaatgataccggctgatatccgcctgtttccagttgtgctgaaaacaaccctccagcgtgaggctgctcgtatctctctttttctgtcatttgttccgttgccgttgtaatgtaaagggtttttaagtctctgccgccgaacgcgcagcacgtgacatatttagccggcacgctgattgaattgatttcttttttctgaaacgggtcaatgtgaacaacgcggctgccgccaaacagcgccacccacagcatgccattttggtcaattgtcatgccgtccggtaatccgtctgactgatcaaaacgatagacaggttctggattcgaaacatctccgctttgaggatcatagctgtaacgcacaatctcctgcgtcggcgtgtcgatgtaatacatcaaattccgctcacggtcccaatccaaaccgtttgaggtggagacttgatccttgattttgacaagactgccgtctagattcaaacggtacagcgacgcctgtttttgctcgccttccatgctcgtcgtccccgcccaaagccttccgtacgggtcacatttagcatcattaaatctcaggctctcatgcatgtccttcggctgtttaattttttccaagctgtcatcccgaagatgatacaggtaaaacccgtccttcatcgtcataatcagttcatcctttgaatatttcgcaagcgccgtcacaaaggatttgaatttgattgatcggttgattttttcttcagggtcaaagatgtggagctcgctccccaggatatcaacccaatataagcggccgttttcttcatcccataacgggccttctccaatcactgcccgagtgtctgcttccaatactgcatccatgtgttacacctctttagcttcagtctatatattgttattcccggcaaagaggtgtccaaaccacttgatgtttattgttttttaaaaaggatggtaatgaccgttccaatgttcattctgctgttcacatggatcgttccgttatggagatggacaagctccttggcaatcgcgagcccgagacccgttccggcagttgaatcttttgtgttcgtccctctgtagtaacggttaaacaaatgggtaatcgtttcttcatccattcctttcccattgtccttcacctttaaagatatatgattttttgtttgctccagaatgacttgaatctctgttcctttgtcgttgtgcttcacggcattcccaaggaggttttctaatatgcgcctgaaccacgcttcatcaagggcaaattcaatatgctcttctttggatacaaacgagatatcatagccttcagaaaacggatttttcttaaaatcctcaatgacatttttaaaaaacgggataaggctagtgagatttctctcaataggaagagcatcatttttcaggcgatacgttaaatttaagtcttcaatcagcttggacatgtattcagatttttctctgacaacctgccccatttctttcacttcttccggcgaccagtcatactgcttcgactcgagcatcatgctgtagccgtaaatgctgctgagcggtgtttttaagtcatgtgacaaaccggcaatccattcttcccttgtcgcctggattttttctctgtttcttttatcccttctcagcgtttcagtcagctgatccattgattcaaatatctcaccgaagaagcggtacggctgtttgatttttccctttttatttttgctgacaggacggccttcccggtttctgggctcctcaagcttcccttttgacagattgaccagccatctaatcgtgtgaaaaatcggcagcccgaatcggaacatataccaaacggtcatccaaatgatatacatgaacaaaacggccatcacgagaaacatcgcttttaatacaaccttcaggaatgatttgttaaactcctgatcggttacatagactgggttcggcaccgtagcgaccatccatctgtctttattgaggatcttaacggaaatttcccgcttatagttccaaggcttagagctgtatttaagcagctccagctggttcatcgtttttctctcgctttttgtgctgttgatgctgtcgagaatctttccattgctgtctaacaggtaaatggcgccttttttccgtttaatatagtcgatggtactggacttatagtgcgctagtgagtctatcttttgttcgcgcttttcaaccgacgtcaggagctgttcactttttgatttccagccggacaatagaagatacgacttatcttcaatattgatggcccaataattcagtttatagttatgaagctttttggttttataaatagacaaaagctctttcttggtataggtgcccggcacgtcttttggcacgccgtaggaataatcagtgtttccttccgaatcaatgatttgcatccagccgtgctgtttatcaacagatttcttcaggaaattatccacttcccatgtcccgtcttcgtttacatcgagatatgcctcaagtgtgtcggtcgttgccttcgtcagccctgaattggattccgcatcgctaaaacgagcgtctaaatagaaaaacgacgcaacaagcataaccgtaagcagcaggatcacaatcagcatctggccgaaaaagtgaaacaaaaacttccatcttaacctcatgaccgcttgccttcaggatttgggataaaacgatagccgagacctcgaacggttacaatatactccggattgctcggatcgcgctcaatcttctccctaagcttgcgaatatgaaccatgacggtgttgttgtcaccgtaggaaggatagccccatactttttcatatatttgatctttggaaagcaccacgttagggtgttcacaaaaatactgcaaaagctgcagaagctgggctgaacaggcaacggcttccccgcctacgatcagctcggcattttgcggagaaaaagtaaagtaatcatatgtgtaggtttgatttgaactcgtttctttcgattgatatgtacgcttgagatgcgctctgatccgcgccgctaattccagcggattaaatggttttgtgatatagtcatcagctccaaccgcaaagcccgataatttgtccgcgtcggatgatcttgccgtcaggaaaaaaatcggagcgtctgaatactctctgatcaatgtgcaggcttcaaaaccggacattccgcccatcatgacatccagcacaatcaagtcaaccttattgaccttcacaacgggaatcgcttcttctgcgcttgccgcatccagtatatttcgataaccttctttttcgagaacgcgtttgatcatgtccacaatcgctttctcatcgtctacgattaaaattgacgcattttccacttttatgttcctttctgtcactgttttttttcatcttatcattatatcgtttatttatggtacatttttgaatacattggagcttggcaaatcaaaacagcaaaaaaggagcaaacaagcgctcccttttgatgttttttcatatgaaaatattatgagttctcatctaccatgtacaaaataaactcccaaaaccccggtacatcctgacataaaagcatatcagccttttcaaacattttgatcttcagctcttgctctaaatcttctctttcttgataggacgtattgctgagtttttttctgatcatcggtgaaaagaatgcaatcaggtgctcaatgtcataagtctcgtctttttgtttctttttttgttcaaactggccgtccacagcttacttttccccctttttttgcgccgctagctgctttctgatattctctagcccctttttatgaatgttggaaatgttttgtcgggactcccctaatgaatctgcaatctcctgcatcgtggcaccgtgaagatacactttcgtcagcacacttttttgtttgtcagtcagcttctggatcgcttggtagagctggtaatcctggacatgctggctcaaatcatcctgcctgtctaaaaattcttcaaatgcatcgcttcctgtttcggaaggaagccgatctcccgcctccggatgatctaccgtcagcggataccgtttttgatttttgcgaacccgcttatcaaaatcaatagaaaagatgcgaatcattgaattcatatacttgacgatacggatttctttataaaattgcttaaatagctcgtccaatgattttgcatctttttcgttagggctttccattacgtttttgaacaaacggtaatgctgaggattgctcaaaaaatgcttcacgatgggatgcttcattatctccttacattttgaccgtaaaagactttgatagtccatcaaaccgcctccctactaaattaaatgaaggaaagcaaaaaaaagtaaactactactttccgcctagtgtcttccaaaatacattgcagcagtttacgttttatcggttttccttcacttacatacatgactgcagaaaaagaagggaggtattttcctatggatcaggtttttatagaggaagtcgtaaaacagatcggcaatttggggtttcccgcgctgattgcaatgtatctgctgacccgattcgaaaagaagtttgatcaactaatagaactaatgacagaactgaaagatcatgcaaaaaaataatttttcaatcgaagttgacttttcactggtttttttcacttaacaaaacagaagggaaaacgaaaggcctttcaccttctctttctgctatcacatttaaatgtaaggaggaaacatttcatgaaaaaacaaaatgacattccgcagccaattagaggagacaaaggagcaacggtaaaaatcccgcgcaatattgaaagagaccggcaaaaccctgatatgctcgttccgcctgaaaccgatcatggcaccgtcagcaatatgaagttttcgttctctgatactcataaccgattagaaaaaggcggatatgcccgtgaagtgacagtacgtgaattgccgatttcagaaaaccttgcatccgtaaatatgcggctgaagccaggcgcgattcgcgagcttcactggcataaagaagctgaatgggcttatatgatttacggaagtgcaagagtcacaattgtagatgaaaaagggcgcagctttattgacgatgtaggtgaaggagacctttggtacttcccgtcaggccttccgcactccatccaagcgctggatgagggagctgagttcctgctcgtgtttgacgatggatcattctctgaaaacagcacgttccagctgacagattggctggcccacactccaaaagaagtcattgctgcgaactttggcgtgacaaaagaagagattgccaatttacctggcaaagaaaaatatatatttgaaaaccaacttcctggcagtttaaaagatgatattgtggaagggccgaatggcgaagtgccttatccatttacttaccgccttcttgaacaagagccgatcgaatctgagggaggaaaagtatacattgcagattcgacaaacttcaaagtgtctaaaaccatcgcatcagcgctcgtaacagtagaacccggcgccatgagagaactgcactggcatccgaatacccacgaatggcaatactacatctctggtaaagctagaatgaccgtttttgcatctgacggccatgccagaacgtttaattaccaagccggtgatgtcggatatgtaccatttgcaatgggtcattacgttgaaaacatcggggatgaaccacttgtctttttagaaatcttcaaagacgaccattatgctgatgtatctttaaaccaatggcttgccatgcttcctgaaacatttgttcaagcgcaccttgacttgggcaaagactttactgatgtgctttcaaaagaaaagcacccagtagtgaaaaagaaatgcagtaaataaaagacttgcggcttgcagagagcactcgttctctgcaagccttcataaggagctgaaccagtgaaacatcaaaacccttcaaaacgcttattgcggctctccataaagtacttgctagccgcagcagcagtggtgttgacctattttgctgtcatctatatattgttttctttagcgggaacgagctaccgctcagcagctcatgtcctgctttttgccgtggtatttcttgttctcggattatgctttgaaccatttgaaaggctgatgatacatagctttacatttttcaagacaggaaaacgtctattcattctccttaccggcatcgtacagctgctatttttgtggatgactgctcatacaacagaccaattgatcagcgacatctggctgtccaccacagaagaaatgattgtcgcagccgtttttttgattttagacaaatgcaactcggctcttcccagctaaaaaaagaacgcattccaattggatgcgttctttttattcatagcgaagcgcgtctacaggctgaagcttcgaagccttgatagacggaagcaagccgaagataatgccgactgccattgaaaagatgagtgctccgacaacagctggaatggagacgataaaaggcatcggaaaaatgaccgtcagcagcttggcgatgccgaagcccgccagcacaccgagtattccgccaatgcttgtcagcacaacagcctcggttaaaaattgaaataaaatcacacgccgcttagcaccgagcgctttcttaattccgatttccctcgtgcgctccgttacggaaacgagcataatgttcatgacgccgataccgcccaccaaaagtgaaatactggcgattccgccaagcagcaatgcaaatgactgattaaaggactccacttcctgcgcgatctcctgaagatccattacactgtactctgctttttccagctcagcttctgacagtccctgatttaaaagatctgcagccattacacccgcttcttggatatgctcagaagaatcagcctgcacggcaatctgcgttggcgcgtcaaacccttcaataagcggccacacttttttcggcacgtacaaaaccgggttcgcatagtcgccttcaaacatgctttcctgttgatttttttctttaaaaacacccacgaccttaaacggcacaccattcatctcaatgcttttatgcagagcttctccgtctggaaacagttcatctctgacagcttcattgatcatcactacttggtgtgtgctgtttaaatcgttttccgtcagctttctcccttcggttattcggattggaaacatgtcgaagtaatcatcgtccactccatacacttggggatacgaaacgtttgttaaatgaaaaacgctcgcgccctctgacaagtaatataatgataatcctttgaccatcggatctgatttgatcgcctttactgtttcttccgctacaggcggcgcggacgcatacgacacctgagggccgccgctctcctcttctccgccagacggctggtatacaacattgatggcgttgtttcccatgccgatcatactttgctttaattgctcactttggcccttcagcattgaaacaatcgcgatgattgccgctatgccgataattacgccgagcattgtcagaatcgatcttaatttatgagagaaaatggattgaaaggagattcgaatatgttcaagcatggctgatatcccctctctcatctaataccagctctccgtctctgataaaaacggttctgtcagcttttttggcgacgtccgggtcgtgggttatcataataatggtcttgccttcccgatgcagttcagaaaacagtgacaaaatttgttcacttgatttggtatcaagcgccccggtcggttcatcagctaaaataaacctcggctgattgacaagggccctcgctatcgccacccgctgcttttggccgccggacagcttaggcggtttgtaggagaccctgtcttttaatccgaccttttccagcgcttcatatgcccgttgccttctctcttttttcttcactttattgtagatcatcggcagctcgacattttgcagcgcggtgagacgcggcagcaaatgaaaagtttgaaacacaaacccgattgattcattgcgaatttcagctaaagccccgtctttccctttcaatatattgatctggtcaagcgtataggttcctgaggttggcctgtccaaacagccgataatattcattaacgttgactttccagaaccggaaggccccataatagctaaaaactcccccgcctgaacagtcagattgatatgtttcaagattggaacttcttcttttcccagcttgtacgacttcgaaatattattcagtgtcagcattgactgtaacctgctttccttccttgaccgcgggatcaggatagatcacataatcttccggcgtcaggccgctcttaatttccaccatgtcattttcatcagtctctccgatttcaacaggctgcttaaccgctttctgattctcatcagctttccatacgtacggttcgccgtcatcctgaatgaccatgtcggacggcagcttgatcgtatccgcatcagcattatcactcatcacttcgatgttgacatgatagccgacttcaagacctttatggctgtctaataaaatggtgaaaggatagttagaggactgggggttcatttcttcatcagcaaagctttctgattcttcaccctcgcctgctcccgctggaagcttgccgatcgaggtgacctttcctttccactcgccctcaccgcctgttttcagcgtgaccctgactttgctgccttttttgatcgtgtccattaacagctcattgatttggcttttgaccagatatttgcctgtcgaaacaatctggatatacgggcctgttgcctggtcgcctgttgcaccgtcagcgatatcctgattgacgctttgaacgattccgtcatgcttgcttgtaatgacattggaacctttgtttttcgtcaggccagccagttctttttgatgctgcttcagttcaagctggcttgttttcaaatcgaaattgacctgatcaagttcatcttgaagctggtttttctcttcttttcctgcaactttcagcttcttttccgtttccgttattgatttttgcaaacggttgatttgcagatttgtcatttcaatttgcaaattggcttgctccacttcatcagaatgatcctcgccctcatactcaaaaagcttatcgccctttttaacctgatcgccttctttgacgtatgtttttttaatgctgcctttttctgaatctatgtatactttctgctgtttctcaggttcaacctttccagaaaacgtttggcctgattctgaatctcctcccatgtataccgcgaccgattcagcatagggctccgatgatacggcaacttggttcatgtgggtaaaaaagtaaaaaccgccagcgccgatcccagccaatacaagcacaccggcacatatcgcaccgccaataagccattttttcttcttggacacaacgatctcctctttctgtaaactatgtaatattttcgaaacattctaaccaatattatctattaattcaaaaagacttgcaatccttttattgaaatgacggaatcaaatagaaaaattgtattttcaaagccgaataaaaaaaatcccggcttcagaccgggattttttcatacagtaactagctctttttcatttttaatcaagtcatatgtcaagcatacaggtttatttgtacggggatcagtcacgatttcggcatcaatctgaaatacctgctttaaaatgtccggtgtcatgacctccagagcagttccttccttgatgaccgtgccttttttgagcgcgatcatataatgagaaaaacgagctgcatggttaagatcatgaatgaccattaaaatcgtccgcccttgctctttgttgagtctgtcaagcagctgcagaatttcaagctgatgtgcaagatcaagatacgttgtaggttcatccagcagaagcagttccgtcccttgcgcaagcgccatggcaatccacacgcgttgacgctgtccgcctgacaatgcctcaatcggccgttcagcatattcagccatgcctgtttcttcaagcccccatttgataatccggcggtcttcgtcatttaatctgccgaatcctgattgatgcggaaacctgccgtacgacaccaattcgtgcactgttaggccgctcggcgcttcaggtgtctgtggaagaatcgccatatcttttgcaatgtcctttgtagacattttatgaatcgctttgccgtttaaatagacggcacctgcatgtgaacgcataattctggacattgtttttaaaatcgttgatttcccgcagccgttcgggccaattaaggtggtaattttccctttaggaatcgatatatttaaatcctctacaatcaccctgtcgccataaccgattccaagctgttccgttgataatgaattcatattcggccccctcctctaattcgctttcatcaataaataaataaagtaaggcgcacctagcacggaaatgacaagtccgaccggaatttctgatggtgccaatacatttctcgccagcgtatcagcaagcaaaaacaggaatgagccgatgaaggcggagaccggtatcagcgtctggtgacgtggaccggtcagccttctagccacatgcggcgcgatcaatccgagaaacgcaatgccccccgcagctgccacgcatgaagcggcaagagtgaccgctgccagaagaagaatccgtctttccttttcaacagcggtgcccagcccggtcgccaattggtctccgagctgcataatgttcaaatagcgtgccttatataaagtaaacagaagcaagatcacaatccaagggagaatcgcccagatcatattccagttcgccccccatattgagccggatatccaaaccgcggcttgcataaaatcatgagggtccatcttaagctgaaaaatcagcaacagggcgttgaacccggcattcacccctatgccgactaaaatcagccgaatcggtgtcacgccttttttccatgccagaatataaatgagaaacgcagcgaggattgctcctgccaaagcactgaacggcagcataaatgttccgaaaaagctaagatctgaagctgacccttgaaaaaagtatataaaaagcactacagcaagtgaaccgccggcgttaattccgagaataccaggctcggcaagttcattttgagacacgctttgcaaaatggctccagctacggagatccctgctccaacaagcaaagaaaggatgatcctgggcagcctgaactcaaataagacaagttcatcacgcgccgttccttggccgaaaaagacctgaagcgttttaagcggtgcaattttgataactcccaaattgagactgataaaaaagaccactacgataagcaaaaaggtcacagccattacaataagcggtttgtttgtttttgttttcattacagccctctcctttcacgacgtgccaaataaaagaaaaagggaacgccgatcagagaagtcagcgcgccgacaggcgtttcaaagggcgcatttacgagtctggccgctatgtcagcaaaaacaagcaaaacagcaccgagcaccgccgagcaaggaatgatccaccgataatccacaccgaccaaaaaacgggtaatatgcggaatgatcagcccgataaatgcaatggtgccggcaatggaaaccgcagctccggttagaattactacaataagcatgccaaccagtttcactgctgatgtatattgtccaagcccttttgccagatcgtcaccgagacttaacactgtcacagaccgggcgataaaaaacgcgagcgttaaaccgacagcccctgcaataagcaaaagctggacccccggccatttcacacccgctaccccgccagcgtaccaaaagctgatatcctgagcgacatcaaagcggattgcaatggcagttgaaatgccggtaaagaaataagtaactgccgtacccgccagagcaagctttacaggcgtaagtccgccccttgaaaacatgccgatgcccattaccgtcgatgcccccagccccgctcccgcaaaggaccatagcacaagccccattgcagaaagtccgggaaaaaaggcaaacgcaatcgaaaccgcaaacgcagagcctgatgtcacacccataatcgaaggctctgccaaagggtttctcgtcatcccctgcatgattgctcccgacactgccaacaatgcgcctacaagcgcggcagccgccgttctcggaagccgaagatcatgtataatttggtgagatgtctttgtcggctgataatgaaaaatggcgtcccatacagtgcgcaaatgaatatccgctgcaccgagggatatggataaaaatgcgccaaggcaaagcaggcatagacctgcaataaggacgatgaccgcgccatatgtccttgacgtccattggatttcttctgatgcagtccgtatatttttatgttgactcaactgccgtacttcctttctgttactgataatgattatcaattgctgtttcagtatatcacttttttcagctgatttaatagagtgttttgaacaaaaatgaaaatgcatttgcaaaaatatcgtgtcaaccggcacttgcagtggtataatcacagatgataatgattctctttttcatctattttttagaaagaaggtatgagatatgacccatatatacaagaaactcggagccgcgttttttgccctgttattgattgcagcgctggcagcctgcgggaataactcagaaagcaaaggttctgcctctgattcaaaaggcgcagaaacctttacatacaaggctgaaaacggaaatgtaaaaatcccgaagcatcctaaacgggtggttgtcatggcagacggctattacggctacttcaaaacactcggcatcaacgttgtcggtgcgcctgagaatgtatttaaaaacccttactacaaaggaaaaaccgacggcgttgaaaacatcggagacggcacttcggttgaaaaggtcattgatttgaaccctgacctgattatcgtctggacaacacagggcgctgatattaaaaagcttgaaaaaattgcgccgactgtcgcagtaaaatacgataagctcgacaacatcgaacagctgaaagaatttgcaaaaatgacgggaactgaagataaagctgaaaaatggctggccgagtgggataaaaaagttgcggccgctaaaacaaaaatcaaaaaagcggtcggtgacaaaaccatttccattatgcaaacgaacggaaaagacatttacgtattcggtaaagactttggaagaggcggaagcatcatttacaaagacctcggcctgcaggctacaaagctgacaaaagaaaaagtcattgaccaggggccaggttatacaagtatttcattagagaagctccctgactttgccggggattacattttcgcgggcccatggcaatcaggcggtgatgatggcggcgtttttgaaagctccatttggaagaacctgaatgccgttaaaaatggccatgtatacaagatggatccgatcggattctatttctctgacccgatttcattagaaggacaactggagtttattacggaaagcttgactaaataaacaaaagagccgcctgcccgcggctcttttgctgatttataaggaacggctcgatttgaatcatatcggatattttctttgagccattcatattaagctgcatccgcatcacgatcaatttttttatgctggagagactgaaaaacgttttttgcatatttaacgaacggattcgtaacaggagaaattgtgattttataaaaaagacacctgagcaaatcaagtgtcttttcattatgcatgtttttctttctggaactttttactcacaaatggataaacgattaagccgacaaagaataaaccgatgccgaggataaatgtcgttaaatctgctgtgcctgttacgataacaaacacggagtatgcacacgccagtatcgcgatcaatccgtctcttacacgggagcctttcagctggtcatacgtttcacctttgatgactaccttcaagctgtagattgcagataccagatacggaattaaatatgcaagtgtagccgctgtcgttaaaaatgtaaatgcgtcacttattgtccgggaaataaccgagaaaatgaagacctgtgacatgacgtttgtaataatgagtgcaatgaccggacttccctttttattcgtttttgcaaaaaatgccgggaaatctcctgctttagcggcttggtatggcacctcagagccaagcaaaatccagccgagcatcgttccgaataaacaaaggatagccaaaagcgccataatcacgcttcccgcgtttccaacaatcgcatagagtacatcaacaaatggtttttcagagccgacaagcttatcatgcggcagaacacccatcgtaattaaagtcacaataatatatatgctcaaggcaatcagcaagccggtaattgtcgcacgtttcacatcacgctgagagcgcgcacggccggacaggatcaccgcggattcaattccgacaaacgcccacagtgtagaaatcgcggcgttatgaacctggccgccaattccaatgcttgtgccgttttctccttgaaccgggaaataaaaatgaccgaataatgccgtttgaaacacaaacaaaccggcaacgataaagaagacaaaacctaatactttagaaagcgttgtgacaaagtttagtttacttgcgccgttaatgctggcaacaagaatcgcgtgcgttccccataacaagatcgtacatacggcaaacgtcagtaattggccgagtgtcacctcttgcccgccgatcgaaaacatctcacgtttatcaaccaagatcgggaagaacgaagtcaagtaaccggcgagacttgtgatgatcgccacgttactgatccagctcgccacccagtagccccacaccattgtgaaaccggcagcgttgccttttttcgggtcagaaaacagcgctcttgcataactttgcggtcccgctgtcagttcaggcttgcgaatggacaaatgtccgaacacaagtgcaatcatcagcacgccggcacctgtcaaaagccaggcggacgtagctccaaacggactcgcaattgaagcaagcgagctcggcaaggagaaaattcctgatccaaccatatttccaacgacaaacgccgttaataaccaaaaaccccatttttttgtctgttccattccagtacctccatgattctttgtacggaccagaccccgagatcatataaacgcaaaaaaagcctgaacaaaagtccatgcttaaagaaacacacacccttgatctccggatagccctccgcgaaaaagcacgcggcagtcctgcacttattcagatacagtcccagcatagagaaggatcggctttctccacacttcggcgctgatgccttttacacatgtttaacagcccctgtcagcctggcatgtgtgacttatcatccgcgcaacctctacctcactgagaaagagtgaggatttaattattcagttactcccagaaggttatcaaagaaaggatgatctgtcaaagggaacagatggaaaatacggatagagccaagccctatccgcatgtggttatcgattattcttctttttttgcacagcttcttgaagcggatcatcttttagagctgaaccagcatcttcaagagctccttggattacgtttttttctttttcggaacgttttcctttatctttattaaagaaacccattcgtatcacctcttttaaaaaataggtacatgtttaagatgcctttttcctgaaaaattatgcgggattttttttatcgtccaaagtcctgttgatcaaacatacattctcttgatatatttgtaattcagagattttttgcaaaagataaaaggagaagcggcaaatgacaggaaaaacacacatcatgggaggcatcgcttcttgtacggcagcggcttattattatggatttgatccagtgcttatggctgcgtcaggcgcggttggagcattaatacccgatatctgccacacacaaagcaaaatcgggagaaaatttcctattttatcgaaagtggtcagctccgtttttggccatcgtacatttacacacagcctgctgtttatgctcatcatgttttttatcacttctacatacattccagataaaaacatatcagccggcctgatgatcggaatggcgagccacttgattcttgacgcttggactgtaaacggaatcaaattattattcccttccacgatccgcgttcggcttccattatatatgaagacaggcagtttttctgagcagctcgtgctagccggcctgacccttgcttcatgttactacttttatatgctgtttcatggccgcatgttttaaacatgagtgctgagacttgtctgaaccggctgtttttagtaggttttacttaagaagcatttcatgcagatgatcaagaaaacgtgaggagtcatattgatgaaaggaaccttttttcacaatcagcggtttttatgtttttcgatcttatttatgtggatcaaaacgtatgtgatatataaactcggctttgatttgcaaatcgatactctgttggaggagctaatgctgctggtcaacccgctcagctttattcttcctttattcgggatcggcctgtttctaaaagaaaacaagcagcgggcctttttgctgattgccaatttggttctgactgttatcttgatctctaatacgattttttacggcttttatatcgattttattaccatcccggttttatttcaggccagcaacatgagcgatatgggcagcagtgtaaaagaactgttccatcctctgtttatcgccctgtttgtggatttggtttttctgctgttgttcgccagaaaaaccaaacacccacagacaaaagccgctccccgcacgatcaaacggtactatgcagcttcctgcggcatgcttttatgcacactggcacttgcagaagtacagcagccgaagcttttggcacattcttttgaccgggaaatgctagtcaaaagcatcggtctgtttcagttccatatttacgatacaatttctcagactgttaatatcagcgcgaaagcttttgccgatgaagacagtataactgccattaaaaactacacagaggctgattacagcaagcctgatcaaagcaaattcggccttgcaaaggggcgcaatgtcatctttgtaacacttgaatcgacccaaagctttgttctgaatgaaaaagtaaatggaaaagaaattaccccttttatgaatgatctcattaaaaaaagctattcctttgatcatttctatcagcaaacagaacaaggaaaaacatcagattcagaatttatcgtcgctaactcactgtatccttcccttagcggcgccgtctttttcacgaaaagcgaccatcaattttatacgatgtataaatcgctgaaacagcacgattattattcagccgtctttcatgctaaccataaaacattttggaacagagatgtcatgtacgatacgtttggcattgaccgcttttttgatgttgatgattttcatgtcactcccgggacatcgacaagctggggcttaaaagacaaagaatttttagagcaggcggccgaaaagctgaaaagcctgccgcagccgttctacagcagttttatcacgttaacgaatcattttccgtttgagattgatgaaaaggatcagctgatagatgaattcgattcaagcagtgatctgttaaaccgctatgtgaccacggttcgctatgaggatgaagcattgaagcattttatcaaaaaactgaaagacgaaggcttatacgaaaattcgatgatcgtatttatgggagatcattacggcatttctgaagcccataacgaggcaatggctgagtttttagggaaagacgaaatcacaccgtatgacaacgttcagctccagcgggtgccgtttatcatacatatcccgggaatcaccgatcaaaagccggaaaccatccctgatgccgggggacaggtcgacgtcaggccgacgctgatgcatttactcggcgttgagacaaaaggcgatatccaattcggcaatgatttgctgtccagcgaccgcaccccattcgccgttctgcgaaacggcagctttattacgaacgattatatatacacaaagaacacgtgctatagccaaaaaacaggtgaagtgctggaaaatcaggatgcgtgcctcccttataaggagaaagcaaacgaagaactgtctctctctgataaaattttaaatggtgacctgctcaggttttccgaatgaaaaaaatccctctatcaagagggattttttacgtttccaatatcaccttgccagtcagctttgtttcatagccgtttaaatgagacaaattcgccttgtagtcctcagaattcaaaatctccttcacgactttgagcagctgctcattttttttcaaaacaacgatatcatattgttcgtcgatgagcgggataaaatcaacactgcccatatgtgccgcgtgctgtgccccgattcccgcgtcagcctgtccgcttgaaacttgtgaagcggcagcgtaatgatcggtcacgatatcgtcgtatccctttacatcagccggattcacaccaagcaagccaagctgttcatcaaggagcacccttgcgccagaacccttttccctgttgatgatccggatatcggctcttttcaagtctttccagccttgaatgtttttcggattccctttttgcacatacagtcctgctttccggagaacgacattgatgagacaaaacggttcacctgtcaagatccgtttcacataaggagcgttatactggcccgtttcagcatcgtacaaatggaggctgacaatgtcacacttgccttgatacatatcaatcaggctgtttaagcttcctttgtatttacggagcggcgtctcttgaatggcattctccaaatgcttgctgagaagatccatcgaaatgtcctgtccgctgatcatgacattcggtctgccgtccggctcagcctcctgcacctgtttcggtgcttctgttgcagcgatgggctgagacattctcatattcgttttatattgctttaaatcttcttcatccacacgcatctgccttccgacacgataagcaggcagcacgccttttttaatcaagtcataaacggtcagctttgataccttcagcagacctgcaacttcttctatcgtataggaagaggtttcattcatcatcatcactctcctattttattataccttttcgccgaatgtaaaaaaacccacataaaccaaacataatcagttataattagttatatctaatgataaggggtgcaatcatgtttaagaagtattctattttcatcgcagccttaactgcttttctgcttgcagcaggctgttcttcaaaccagtcttcaacggacagcgagaaaaaagtaacgttaaccatctcagctgccgccagcgcgcaggatgcacttgaggaaatccaaaaaaattatgaaaaagatcatcaaaatataaccatccaagataactatggctcatccggcgccttgcaaaaacagatttctcaaggagcaggagcagatctgttcttctcagctgctgaggataaatttaaaaagctggtggatgatggagatatcgcaaaaaaagacagcactgatttagtcggtaatgaaattgtgctggtcgtaccgaaaaacggagattcacctgtgacaagcttcagcaatctggctgaatcagaaaaaatcgcccttggcactccggaatccgtaccggcaggagcttatgggaaagaatcactgacaaagctgtctttatgggacaaagtgaaggataaaattgtgtatggaaaagacgttcgccaagttctttcttatgttgaaaccggcaatgtagacgcaggtgttgtttataaaacagatgccctggtctcgaaaaaggtcaacattattgacgaggcaaaagcagatacacacagcccaattgtctatccgttaggaatcgtaaaagatacaaaaaaccgtaaggaagcgaaggaattttacgaatacctgcaatctgatgaagcaatgaaagtatttgagcaatatggctttactgccgagtagcataagcgcttcagaatttttcacacccgttgtgctttcctttcaggtggcggcagttgccggaattgctgtcattattctcggaacacttgctggagcatggatgtcacgggcatcatttttcggaaaaacggcactcgaaacatgttttatgcttccgctcgttcttccgcctactgttgtcggttttattctgatcgtcattttcggaaagcacagcttcatcggacaagccatcgagtggattttccagcagcctgtcattttcacctggtgggccgctgtgatcgcctcggctgttgtagcctttccgcttatgtatcaatcagccaaaaccggatttgctgacattgatcccgatatacaaggtgcggcaatggtagacggcgctagcagatggaaagtgtttatccatatctccgtcccgcttgcctatccttcgttactgaccggaagcatcctctgccttgcgcgggcgctcggagaatttggcgcaacactcatgtttgcaggaaacatccccggtgttacgcaaacactgccgacggcgatatatgtcgcattggattccggcaacaatacccttgcctgggcgtgggtcgtctgtattgttgtcatttcctttttgatgctgtttttcattcaacagaaaaaaacgcactaaaaaactccccgtaacggggagttttttgattaaaacagaagctcatcaggatttgggccgacacgctcatctttgtttaatgcgtcaattttgtccatgtcttcttgagacaattcgaaatcaaaaatatcagcgttttcgatgatacggtgttctttaatggattttggaatggttacaacttcatgctgcagatcccagcgcaaaatcacttgagccacagatttattgtgtttttcagcaatctgtgtcagcacttcgttatccaaaagctgtccctgcatgagcggagaccacgcttccagctgaatgccttgccctttgcagtaatctcttaattctttttgcgtcaagcgagggtgaaattcaacttggttcaccatcggtttgatttcagcatctttcaacagctcttctaaatgatgaacttggaaattgctgacgccgatcgcgcgaattttgccgtctttgtacagcttttcaagcgcgcgccatgtatctttatatttatctttgccaggccagtggatcaaatataaatctaagtaatcaagctgcaatctttccagactcttttcaaaggcagcaagcgttgtttcgtagccttgatcttcattccacacttttgatgtgatgaagagctcttctcttgccacaccggattctttaatcccgatgccaacgccttcttcatttttgtagatcgctgctgtatcaatgctgcgatagccatttttaattgccgctttcactgattcagtcgcttcattaccattttctactttaaaaacacccagaccgaaccaaggcatttcaactccgttatgtaactttacagtatcttttaaacttgttggcacttgaacatccaccctttcactgaaatgtaagcgtctatattatctcacattcctctcagccgataccaataatacgcttaagaccctctttttgcttcttttttcacagcacaggcaaatccaaacactatttttttcctattttaacaatattgagattacaaatacattgagcagggtatgcgtttagtgtaaccaaatgaaaacaaaggaggaaacaacttgaaacgtattcgtatcccaatgacacttgctcttggtgccgctttgacaattgcccctttgtcctttgcttccgctgaagaaaatcctgctccgaagatgtcgcagacaactgctgctggaacaactgccgctgatgtaggtttaaacgtcaatctggatgtacttggaattgccaaccagatcgctgatgccatcaaatccgcacagaacagggatgggtttgtgaaaaacctcatggagtcttccttctacgcatccggccaaaaatataatgtcatggtctttaatttaagccaggaatatgaagatcatttgaacggtgtgcaattttacggctcagccgtttacgacggcattacgtatggcatttgggtatttgaagatggaacctttacaaacaaaggcgatggcggctggatcaactgggccttcagaggctggttcgaccgggatggcagcactgtcgcatttcatcgcccttaatatagaaaaaagctggcgctctaacgccagcttttttgctgcatttattcgccgccttcaagcatggcggcttcgacatcattaatgtattggcgaagctcatgggaaatgtcccgggaaatttccctctcttcgaagagcgtttgaatttcatttctgatcgcctgcacagccttcagctttacttccagcttctgattttcaaaatgggcgcttgatttcagctcatgatggctgtgctccagcctgaaaattaactgtttatagaacgaaatgacagataaaaatacttctttatgttcttccgtcttatgtttttccagatattctatcgctgcttttgccgttttcactcttgttgcccgtatcaatcccgcttcatttaaaatcgacatctccggctttttatgttcaccgaagaaaatccaatacatcagccgcttgagccttgtttttgataatccgactttaaacgggttcgcatacaaaatttccaactcgttaaatcgttcttgcagcacatttgctgtttcttccgggatgtctccccgctccagcattttcatcagcgcctcttgctctgccttaaccccttgcgcacggacttttcgctcgtgctttttgatgcgattagacgatgtatattgctgaaaacgaagatttttcattttctcattgtattcagctatcaccgcaagagaggccgttttgtttgtctcattcatgtcctctttaatcgtttgaagggctgttttgatcaatttacgtctcgccgtcagcagcttcttgtttcgttcttcgtcctcttcttctttttcagtcagaatcggcagcacaatggtggcaatgacaagcgtgcataaaataacgccggctgctaaaaagagaatcagatttctttccggaaacggcgtgccgtcctccagaaaatacggaatggaaaaagaacctgcaagcgttactgctccacgcacaccggaaatcgaaattaacagcgtcgaacgaagaccaggtttatagatgttctgatctttattaaagaaccatttgccgttccagaagaacagcacccacaggaatctcaggagcattaacgtaaatgtgatgactaggatataaccgatcaccttcatgttgctgatggcagtgtcgttaaagataacagaaataacatcagggatttgtgtgccgagaataacgaagaccaggccgttcaaaataaataaaataatgttccacgtacttgaggagacgatttgcagcttgatcatcgtagattccagacgatcctgttcaaccgcatgggtaataccgccagccacaacagctaaaatgccggaaacgccgatttcttcagctgccaaataaatcacaaacggcgtcagaatttgaatcagcatatgcatcgtgacatcctgcatgccaaggcggcgcagaaataggcgaaaacgaataatcaaaaatgaaatgacaaccccgcacagcaagcctccgagagaaataaagacaaagctgacagccgcttgtgctaatgaaaatgcaccagtcactgccgctgcaatcgcaaacttaaaggccaccagacctgatgcgtcattcatcagcccctcaccttccagcaggcgaagaattccttttggcattttaacccttcctgataatgcgctgacagcgacgacatcagtcggtgaaagaatggccgcaagtccaaaggccgctgccagcggaatagcaggaatcatccagtgaatcgtgtagccgcctacaatcacagtcgcaaatacaaggccgagtgcaagcaataaaatcggagcccttaaattccaaagctctgcccgcggtgtcctctttccatcattaaatagcagaggcgcgataaacagaacaaaaaacaattcggtatttaattcaaaatgaagaccctgtggaaatgaggcggcaagaatcccaagagccacttgaatcagcggcaccggaataaacggaataaaccggttcacgatattagaaatcgcaataatcgttaataatacgagcacaactaaaaatatgtccaaatgcatgacctccttcgtctgttgtgtgtcggcatgatgagccaaaaaatctgtttgtctaaaagcccttgagctagggtggccttgcatacgctatgtggtttcgcaggagttctctccacacttgtcttcttttatagtaccctttttagggtattttttctcatgatatgctcacagtgaacttttttgcagcagagcaaattacagaaaaaagagacaggaagctactccctgtctctcatctttctttctcaatcatgaaaattcgtaccgtcagttgttgctttgataatgcccgcgcggatgacaaagtcaccgaaatgctcgccttcctcacgttctttcgcatagcgggaaagaaggatgcgcagctcgcttaaaatgtctgcttcaccgatgttttcacggtacattttgcttaaacggcttccgtcaaacgcagcgccaagatacatattatatttgcccggcgcctttccgataaatccgatctcaccgagtgcatgacgtgcacagccgttcggacaccctgtcatgcgaatggtgatttcctgatcacgaaggccgttttcgtcaataatctcttcaatcttatctaacagggtcggcaaataacgttctgcttcggccattgccaatccgcaggtcggaagagcgacgcatgccatcgagctgcggcgaagtgctgaatagtgcttgccgtcagttagtccgtactgttcaattaaagcactgatttcttcttttttatcgcttgaaacgttcgcaatcattaagttctgattggctgtcagccggaactcacctgtatgaactttggcgatttcccgcaagccagtcatcagcttataatcatcgtaatccgttatacggccgccttcgacaaacagcgtgaaatgccatttatcctcgatgccttccacccagccatagcggtcgccgttatgatcgaaatgatacagcttcgcttcttccaggctccagccgagacggttttccaattcttcttttacgttttctaaaccgaggcggtcaactgtgtatttgaaccgcgcatttttacggacagaacggttgccgtaatcacgctgaatcgtaatcgttttttcagcaacgtcatacatttgctcaggccggcagaaaccgatcaccttggctaattgcggatatgtcgcagtatcgccatgcgtcattcccataccgccgccgattgccacgttaaaaccgatcagcttgccatcctcgacaatcgcaatgaatcccagatcttgtgaaaagacgtcaatatcattagacggcggaacggcaataccgattttaaacttccgcggcagatagagcggtccgtacattggctcgacttcttcctccggcgtgccggcaactctttcctcatcaagccaaatttcatgatatgctctcgtccgcggcagcagatcatcacttaattttttagaccactcgtatacctctgagtggatttcagattgataagggtttgatgcacacatgacgttacggtttacgtctccgcaggctgcgatcgtatccaaaagtgctgagtggatcgtctgaatggttttcttcatgttccatttcagaattccgtgcatttggaatgtttcacgtgtcgtcaattttaatgtgccgttcccgtatttctgggacaggtcatccatgacaagccattgttcaggcgtcgagacgccccctggcatacgcacgcgcagcatgaactgatatgcgggctcaagcttctgcttttggcgttcatttcggaggtcgcggtcatcctgcaaataactgccgtggtgtttcatcaggcggttatcatcatccggaattcccgcactgattcgatcgagcatcacttctttcagcgtgccgcgcaaataatcactttcttttttaatgcgttcaacatcacttggagagccgtccggtgcttttagaattttggtcaccatgttgaaaaactcctttcaagtcaaatcaatatacatcacgctgatagcgtttttgctgctgcatatcggcaagataagcctccgcctcttcgcggctcatattgccttctttttcgataatttcaagcaatgtgttatggacgtcatgcgccatgtgcttttcatctccgcaaatgtaaacagccgctccttcttgaagccattcaaacaattctgcgctatgttcaagcatgcggtgctgcacatatactttttcttccgtatcacgtgagaacgccacatccatttttgtcagcacaccgtctttgagccaattctgccactctgtctggtaaaggaaatccgtgacaaagtgctgatcgccaaagaacatccatgcctttccttccgctcccgtctcctcacgctcctgcataaaggaacggaaaggtgcgacgcctgtcccagggcccaccatgataatcggtgtttcagggtctttcggaagcttaaagttttgattgtgctgtacataaaccggcagtgtgtctcctggctgcagacgttccgcgcacaaaatcgagcagacgccttttcgttcacggccgtgcgcatcgtagcggactgcgccgattgttaaatgcacttcatccggatttgcggataaactgcttgcaatcgaataaaggcgggcaggcatttttcgcaaaatcgagacaaactcctgcgcagatacactaaatgggccatagtcacggacgagatcaagcaaatcgcgccattcaatataggcttttacattctcctcatttcccggggctaaaagctctctaagctcatcgttccctgtcagctgggctgcctgttcaagaagcggttttgtgagaacggtaatctcatagtgagaaatcagcgcttctttcagcggacggacatcaccttgcttattaagcgtcacaatttcttccgggtcccaattcatttccttaaggagcagctcgacaagttccggatcgttttctggatagacgccgaggctgtcaccaggctcgtaagtcaggcctgatccttcaagagacagctccacatggcgtgtttctttatttgatcctctgccgtttaaatttaaattttctaacacttcagcccgaaacgggtttgttctggaatacgaagactcaccggtttgagacgcagccgccggcgcaggcgcggcggttccgcccccagcttcatttaatcccttcaatacaccctcaagccattcggctgccggttcatcatagtcaagatcgcaatcaacgcgcggagaaatccgttttccgccgagttcttctaagcgctgatcaaattctttccctgtctggcagaaaaattcgtacgaactgtcaccaagcgccaaaacggaaaagcgcaggtcttcaagcttaggcgcccgtcttccgtgcagaaattcatgaaacgacagcgcgttatcaggcggctcgccttctccatgcgtactgacgacgattaaaagattggttaccttcttcagctgattcggcttaaaatcgctcatggatgagacggtcacttgaaaaccgctctgttcaagctgcttgccggcattttccgcaagcccctgtgcgtttcccgtctgtgaaccataaagaacggtcacttcttttgaaacggccggtgcttccgcagacacagctgccgccggcgcacccgcagtttcttgggcggaaacagattgcgcggataagtatccgctcagccagattttctgggattcggtcaaggtcggcagaaggcggttaaggagctctgcctgctcctgattaaacggactgttcattacctgaagttgcaacgtatccacctcacaaagttataaactgatcgaaaattgcatctaattgaactttaccggaatactaggcttaagtaaaatatatttacatgatgataactattaagaatcctaatgataaaacggctatgcttcatgtaaatagaaaaaagagaaggactcccttctcttcattcaacaatctgatataagtgaggcggcacagcggttacaaacggactggcttcacctgtataaaataccgccagcatgtgcatcgcacgggtgcacgcagtatataaaagcctgcggtcgtgctctgtatgatagtgttcttcagatgcatcatagacaagcactgcgtcaaattcaattcccttcgctaaatacaccggaatcacgcaaacacccttttgaaatggttgattttctttatgaatcaggcgaacatctgtatattcactcatgtgggcgtgcgcctgtatgcattgctgcgcagtcttgcagatgacggctattgtttcgtgcccttttttcttgagccggccaatttcttgcgcgagcttttggcaaaggctctcatgtccttcagttttgacaacgagcggcatttccccgcttctattaaacggctcaatatccgctccatcttgaagcatcgctttggtaaactcgacaatctgccttgttgatctgtatgttctctttaaacgaacatactcagcaggctcatcctcaaagcacgcatccatacgctgatccccgtgtatggtatgcgcgtagatggactgattgatatcaccgagcactgtcatgctggcagccggaaaaatgcttctcatgtaagccatctgaaacggtgaatagtcctgggcttcgtcaataaatagatgtttgatcttcgtatttttctttctgccctcaatcagatcctgcatataaagaaacggtgccgcgtcctcatagagcaatttattatccgtaaatgccgaacgggtcagctcacctatcgcatccatcttctcatgctgaaattttcctccccagccagaaaacaattgcaaataaagttgtgtaacatcaagaaatgcaaggagtctgaccgcctgtttgagcggtttgaaagcttttttcacaatgatggcggcaagcagctgctgctctctttgataatcgttaaacgtactctcgctgaaccgtttcctttcctgcagttttttgtacacgtccaagtagtcctctttgtcaagcagctcagcttcatgaacaacccaatcctttcgccgttcctttttctcaagcttgttaagctcactcagcagccacttcgcggtttgctccatccgattcggaatggagtgattttgatccaatgagtaaaaataggattgaatttgctcctttgtgatcagcttttgtccgcggaatatgatatttttaaaaatcatcccttcagaggaaagccgtgtgacgtattcattaatgaattgctgaaaggataaacccgccttccatgtgattcccgcgagccttgttggaaaatcgccttccttagtttcggtcaggcaatattcgagctgatcaaaggcgctttcacatttgaacttgcggccaagacgatgctcgatatattcctgaaacgtcgcctgctccatattctcttctcctaactccggcaaaacagaggagacatagctgttaaataagaagttgggagaaaacaaaacgatttgtccggcatcaatgacgccgcggtgcctgtataacaaataagcgacacgctgaagcgcagccgatgttttcccgctgccagccgctccctgcacgatcaggatcttgcttttttcattacggataatctgattttgttctttctgaatcgtagacacgatgtttttcatttgggtatcggagtgatggcttaatacctcttgcagcatttcatcgccaatcgtcatatcggtattaaacatcgccttgagagtgccgtttttgatcataaactggcgtttcagcaccatttccccttctatcgtttcaccgggcacctcgtactccgcttttcctggagaataattgtagtacaaacttgatatcggcgccctccagtcatagatcagaaagtgttcctctttctcatccaaacaggaagctaaaccgatataaattcgctctgcctccgcctcgccgttttcaataaaatcaatccggccgaaataaggcgattttttcaattgatgaattcgtttgagctgctgatccatgcgccgatgattctgttcccgatcagacagcagctctgcctgctgcttaatgcttgccatcgtttcaatcgcttcatgggcatcatcaaaattaaccttaacatcctcccaaaagctttttcttaatccgatgatatcatgcttcaacccgcccgcagacgtttccagaaaccgctcttttttttcgagctccttcagcacctcatctattctcgactgctcttccttccattccttatcctgctgattcatgaacggcacctccagaaaatagttgacaaacatagatgaaatactgtaaaatataattggatacatatattaaatatatgatgtaaaccggcaaatacaatttataatagcacattcacccaataccaatcaaggtttgggttatttatatgcagaaaaaaccgatttcaactcgaaatcggttttttctcttatgatttcacattgatcactgttggacgtgcttttcttaggttgcgaatcttctctttcatcagtatcgattcctttcaatcttcgatataatatatctttttcattttaaaaacaccgcagagctttaccgtgtttgtctgttcatctaacgtgaagaatgactaaacttgttattgtcatcttccataaagcgactacatccttgctatcgtatctatagtcgcagtaaaatagtcatttttcatccaatttcgacatatttcaacaaattaaagtttttcatttgggagaataggacgatgttacattatttctctcggtttatgatatgaacatgaagaaagaaccagaattagttaggaggaaatactcagtgaagaaaaagctatctatgatgttgctggcattcgtcgtagccgtaacaagttttacggctattgacctagtaaacaacaaagcggaagctaaagattgggttaaaaaaggtcaaatatggagtactcattaccattcgggctcatttaaaaactatacttactcgccaacttttcatatttattatccaggacaaggaacttgggccaacattacagcaaacggatcaggcagcgggaaaattacagcaactctgcaacaaaagacaaataaaggctggaaaaatgttaaaactttttacgcaacgaaaaaaggctctacaaatttaagttacaaacaagcttctaaaagctacaaaacaaaatacagattcaaattcactaacacaggaactaaaaaaaccatcagctataccttttgggctacctattaatttcaaatagctttgttctgcgcggtttcgaaaaggactttttatttgatcccggcaggctaccataaaagaaacctctccgtcatggagaggtttcttttattttactgactatctaagcgaaaagaacggtttggcagcttccaattaaacatataggaacaaacccggcaaacaacgagcacgaaaaacagaacgtacaagccaaacgagttccccagccagcccaagccgacgattaaaccgccgagagccgcccagactgcataaatttctgccttcagcacaagcggtttgcgcccggctagaaggtcacggatgattccgcccccgcttcccgtcagcaccgcagccacgatcacggcactaagcggatggcccattttgacggcatacagtgcgccttggatagcaaaggcagcgaggccgatcgcatctgataaattgccccacttattccaatgcttcagcagcagcttcggaaacagaaacacaattgtaatagataaaagcgcgatttgaaagtacgctccctgctcccatagcgctgacaccggaacgccgatcagcaaattacggatcgctcctcctccaaaagctgtgacaatccctaatatataaactcctaaaatatcatattcctcttccatcgcaacaattgcgccgctgactgcaaacgcaatgatgccaatcacactaagcagctcccaagccattctgatgactcccttttatgtttgttaaattttctgacgacctctagattttataatcgctccagcgtaaaatcaataacatttttatgagaaaaaaagataaatttagagggaatacggctattgctgatggacatgagtttgcgaaattaaaaaagcgcccggcatacgcgggcgctttttttgttattcagatttttcgcctttcagcaggcacataaaaatgataatcaggataaaagcaatcagggccaggaatggaatcgtaataaaaccaaaccagttaatatattggcccgagcacggcacgccgcttacacacggcttaatgccgctaaaaccgggcactttttgttctaagtaatgcatggttgaaatgaatgcccctataatcgccatcgggagcacatattttttcactcgtgtgtccccttgaaaggtggcgatgcctaaaatcagaacgagcggatacatgaggatacgctggtaccagcacagttcacatggaataaactttctgatttcactgaaatacaggctgcccagcatagcgataagagccacaacccaggaagcatataaaaatacgattctatttttcatatcgttacttccctttcagctctttttctattgtctctttgatttcatcataatccgcaaaatttttgatcactttatcattgacgtaaatcgtcggtgttgcctgtatgttcattttttgattaaggtcagaatccttttccacttgagaagcgaatgtttccttatcaagattttccttgagcgtctcaggttttatctttgtggtgctttttgcaagatcaccaaggaggcctggggttacccattcctgttccgtatccggctgtttttcgaacagcttttcatggaaatcccagaaagagtcagggtcttccttccatacttcttcagatgcaagagccgctaatcttgaaccttttccatggaacatgacgttcacgaaagaaaatttcacatcgcccttatcaataaagtctttttgtatttttggaaagatgtcactgttaaacaccttgcaagacggacatttgtaatctccgaattctactacagttaccggtgcatcgtccttgccaagcacaggctgccctttgatagacggctgtccggaaaccgcatcattgccttgttccgttttgttattaatgatgacaatggctgctagcaatacaacaaccacaaccgtaaggatgaccgcgaatttcgcagaagactgctgtttctttttcactccgacacctcatcgttttaaaattaaaaaagaagcggatcgcaattgatccacttctttattttaacaagacaagcgccgataagaaaaccccgaaaaaatgaattctctccgacaatttatttgtttttgagacgcatgacgcgcatagcgtttgccacagcgagcagtgtaacaccgacatctgagaaaaccgcttcccacatggttgcaattccaaatgctccaagaatgagaaagatcgctttcacacctaaagcaaagccgatgttttgccacacgattcgccgtgtccgtttcgcaatccgaatcgcttctgctatttttgacggctgatctgtcatcagcacgatgtctgcggcttctaccgcggcgtctgacccaaggcctcccatcgcaacccctatatctgcgcgtgcaagcaccggcgtatcattgatgccgtcaccgacaaaaatgagtttttcactaggcaaaagcttagcttctaatgcttcgacctgcgccactttatcttgcggcagcagctctgcatatacctcaccaatcccaagctgttttccgacggcttctcccgtttgtttcgaatcacccgtcagcatagctgtctgtttgatcccaagcgacttcagatcagcaaccgcctgtgctgcgtcttcctttacttcatccgctatgatgattgctccggcatagcgttgatcaacagcaacgtgtacgattgttccagcattttcatccgggacatcctcaatttgttctctttccatgagctttttattcccggcaaggatctcagttccatttacctttgcaaaaatgccgtggccggggatttcttcgtatgactctatctcatcggaggaaagcattttcccgtaagctttacgcacagattcagcaatcggatgctgtgaatgaagctcagcgtatgccgccgcttcaagtaatctatcctttgtaaaaccttccgcaggtttgatttctgtcacttcaaagctgccttttgttagtgttcccgttttatcaaacaccgcgtatttgacttgattcaaggcttctaaataattgcttccctttacaagcactccggcctttgaggccgctccgattccgccgaagaaaccgagcggaatagagacaacaagcgcacaaggacaagaaatcactaaaaagataagcgcgcggtacacccaatcggaaagcgcggcgccagaaagaacaagcggcggaacaaaggccagcaataccgcaatgatcacaacagcaggtgtataatacttggcaaacttcgtgataaaggtttctgtccgggctttacggctgctcgcattctgaaccaagtctaatatttttgatactgctgattcctgatagccctttgtgacttcaatatgcagaacgccgttttgattgataaagcctgacattacatcttgtccttccgcagcttttctcggaacggactcacctgtcaacgcagatgtatcaaccatcgctgacccttgcacgaccttaccgtccaagggtatgctttctcccggattaaccacaatgatgtctcctgtctgaacgtcctccggggaaacctgttcgatgccgttctttgttttgagattggcgtaatcaggccgtatgtccattaacgcactaattgattttctggaacggctgaccgcggctccttgaaaaagctcaccgatttgataaaacagcataacggcgaccccctcagggtattgctgaatcagaaaagcgccgattgtggcaagagccattaagaaatgctcatcaaacacctgaccgcggatgatgtttttgactgcgcggatcataatgtcaccgccgataatcaaataagcaccgaggaaaaggaaaaattcaatggttcccgaatgaaccaaatatgccgctgcgccgagaatgacagccgccgccattctgatcagcatattgaccattcgattacgatagccatcatcagctgatttctttatatgcttttggcgaaccgttacatgcggatcaattgatttcacttttttctctactttattcgtgacccattgctcttctttcccatcggctgagacagttaaggtgcttgccgcaaaatttaccgcgcatccgtcaatgccttttatgcctttgactccattttcgattttttgggcacaattactgcaatccaaaccgtccagaacgtattcctgtttcactagtctcaccttaccttccgatttagggttccctcttcaaagcgtatcaatgagtattgcattctttataatatatatgagcatatactcatataatagttacacctattatatgttgttttccaagaaagtgtcaatgaaaaacaaaaaccggcatatagccggtttttcattttactttctgcagacgaagagcattcagaacaacggaaacggagctgaatgccattgctgctcctgctatccacggtgctaaaaatccaagtgctgcgattgggatgccgaggctgttatagccaagcgcccagaataagttttgtttaatgtttaacattgtcaatctgctcatgcggattgcgtcggcaatgctgtttagatcgccgcgaataagtgtaatgtctgctgtttccatggcaatgtccgttccagttccaatcgccatgccgatgtcagccgtggcaagcgccggcgcatcgttaattccgtcgcctaccattgctgtctggcggccttctttttgcaggcgggcaatttccgccgccttttgttctggaaggacttccgcaatgatattcgcaattcccgcttccttcgcgatggcttctgcggttctgtgattgtctcctgtcatcatgatgacatcaaggcccaactctttcagacgggcaacagccttccgcgacgtgtccttaatcgtatctgcaaccgctactagcccagctgcttctccatcaatggatacaagcataactgtttttccttcagcctctagctcttccattttggcgagaagagccccatgctcaacctgttcgctctccattaattttcttgtgccgacgagaatgctttttcctccggcttcagccaaaatgcctgcgccgacttttgcttcaaagcgggtaagcttcggtatctcaagccctttatctttcacgccagcaataatggcttcgccaagcggatgctctgatcccgtttcggctgccgctgcaaattgaagcaaatctttttcttcaaaacggccgaatggaatggcatccgtcagacgcggcttcccgtttgtcacggttccggttttatcaagaacaattgtatcgagacgatgtgttttttctaaatgctcgccgcctttaaataaaatcccgaattcagcagcgcgtccagatccagccattatgctcgtcggagtggcaagaccgagggcgcaagggcaggcaatgacaagaaccgcaatgaacttgctgatcgcttcagcaaaatcgccaggagccgcccaaaggtaccaaatgagaaaagtgagaacggcaatccccaatacaatgggtacaaaaatgcctgaaatctggtcagcgagacgctggatcggtgcttttgacccttgtgcttcctcaacaattttgatgatatgagaaagcgcagtatcctttccgacgttgacagctttaattttcagaaagccgtttgcgttaacggttgaacctgtcacgctgtcaccaggatttttgtcaacaggaagactttctcctgtaatcatcgattcgtcaaccgctgaacggccttcaaccacttctccgtcgacaggaattcgttcgccaggtttgacgtaaacaatgtcattaacaagcacttcgtcgatcgggatgatttgctcctgtccgtctcttacaacagtcgctgttttcgcttgaagcttcatcagctttttaatcgcatccgaggaacggccttttgcttttgtttcaaacaacttgcctaataaaatcagcgtcagcaaaatcgcgcttgtttcatagtaaaggccgtctgtatgcccgtgagagccaaggctttgaaaagtaagataaagactataagcgtaagcagccgtcgtaccgagggcgaccaatacatccatattggcgcttttatttctgagcgccttataagcacccacataaaacggccagccgatcagaaactggactggtgtcgccagcgcaaactgcatccacggattgagaaatatatccggtacccaaatgaatgatgtaaatgtaaaatggctcaccatcgcccaaagcaatggaaacgacaggacagctgaaaaaatcagtctcgccgtttgcttccgttcttctttctttttagcagcagcctcactgtcctgttcacccttcaactttagcttatatccaagcttatctaccgcttctttcaaatcgctgacagacgcttcttttggattgtattcgaccgtaactgtttctaaagcgaagtttactggagcatttgcgacgccttctattttgttaagccgtttttcaatccgattggcgcaagccgcacaggtcatgccttcaatatcgaattcagctttttctgtaacgacgtgatagcccagcttttctattttttcttgaatcgctgcagtccctgtttcagcaggatcgtagattacatttgatgtttccgttgccagattaacatttgcatccgtgacaccgggcatccgcttcaggcctttttcaattctggcagcacatgccgcacaggtcataccagagacctgcatcgcgatttccttttgttcactcaacatactcactcctttatatacacctggggggtatataaaaatgaaagaaatatcgcgcctccctaaaggcgcgataccttgaatcactcagctacgtcatagccctgatcctctatcgcatccgcaatatctttgactgatactttgtcagcatcaaacgaaacatcgactttacccgcttccagattgacatgaacggcactgacgccgtccagttctcctacgcttgtttctactgctttgacgcagtgctgacaggacattccttcaacttgcaatgttttttgttccataatcaattcctcctgtttattctttgtatttttatcctaccatacccccgtagggtattacaataaaaatacgctttatgattttgtgaactttttaaatacgtccaaaagctcagaaatggcctgttccccgtctccgcttttgatggcatctgcaacacaatgatgggcatgatcctcaagcaaatgaagcgccacatttttcattgccgcctgaacagctgaaatttgcacaagaatatctacacaatatctgtcgttttccaccatgttttgaatgcctctgacttgaccctcaatccgcttaagccggtttgtaatctgatctttttctttcgagcttttatggtttaatgttttatgttcgttatgcttttccatgcgcacacctctgtttaatgatattaattcccattatactgattgtccaaacggttgtctaagcatgccgacgcaaaaaatgaatcagttaggttttaccatttgatcaggagggtatatacttctgttgataacgcttttaaaggggagaagaaaagtggatacgatcaaggttggaatattaggatacggattgtccggttctgtttttcacgggccgctgctggatgttctggatgaatatcaaatcagcaaaatcatgacatctcggacagaagaagtgaaacgggattttccagatgctgaggttgtacatgagcttgaggaaatcacaaatgaccctgccattgagcttgtcattgtcaccaccccgagcggccttcattacgagcatgctatggcatgcatacaggccggaaaacatgttgtgatggaaaaaccaatgacagcaacggccgaagagggggaaacattaaaaagggctgccgatgaaaaaggcgtattattaagcgtatatcataaccgacgctgggataacgattttttaacgattaaaaagctgatctctgagggatcccttgaagatatcaatacatatcaagtttcctataaccgctacagacctgaagttcaagcgcggtggcgggaaaaagaaggcactgccactggtacgctgtatgatctcggctcccacatcatagaccaaaccctgcatttgtttgggatgcctaaagccgtgactgcaaacgtgatggcccagcgggaaaatgccgaaacggttgactattttcatttaaccctggattatggcaagcttcaagccattctatacggaggatcaatcgttccggcaaacggacctcgttatcaaatccatggaaaggattccagctttatcaaatacggaattgacggacaggaagacgcacttagagcgggaagaaaaccagaggatgacagctggggtgcagatgatccggagttttacggacagcttacaaccattcgtggctccggcaaaaaaacagaaacgattccatcagtaaatggctcctaccttacttattaccgtaaaatagcggaaagcatacgagaaggtgctacgttgccagtcactgctgaggaaggtattgatgtcatccgcatcattgaagccgcgatgaaaagcagtaaagagaaacgaaccattatgctggagcagtaaaacaaaagcctccccaaataaggggaggctttttcattagaatgtttttcctgcttctttcgcacgcgcaatcgcgtcttctttgatttgctgtgctttatcaggctccgcattatgtccctctacgaaaatgccatcgaatgatggtacgccgaagaagttcatcatgatgccgatgtagcggtgccccatttccatctcagccgcagggccttctgaatagtagccgccgcgcgcttggatatgaattgcttttttatcagtcaacaagccaatagggccttgttctgtgtatttgaatgattttcctgcaacagcaacagaatcgagatacgctttcatcactggcgggaatgagaaattccataaaggagtaacaaatacgtacttatcagctgatgcaaattgatcgctaagctctcccaaacggcctactttcgctttttcgctttcagaaagctcttcaaagcctgtacctgactgaagctttccccatccgctaaatacatctgcgtcaatatgcgggatgttttctttgtacaaatcgatatgtacaacttcatcatttggattcgcttcttggtaagaatcgataaatgctttacctgttgccatactatacgaagttgcttcgtcatgcggatgagcagtgatatataatacttttgccatttttaccagccctttcgtttttaaaaatcacacatcaattattatcatacagatgcataatgattattctgtctctcttagactttattatagagacaaagaaatttactttcaagtaaaacatctcgaattaaagattatttaactttcccaaacagcttacttttcaaaagctgttctcaagccggaatacagcgcggacaattctttactgatccgaggataatgagggacatgcggcacttgaatatccgcaggcatccttttcatgataaaggattgctcagcctgttcaaaaaacgcccgcagctggttgatctcttcatcagaaaacggagcaggcggacggcggtgagcttgcgccgagagcaaatagtaccctaagtgctgagcaccggaaatggcaggccagagcgcctccgcattcgcatgaggaaactcgccaagggccttgtcatacgcatcccgaagcctgacaaggctcacccttaacttgtgttcgtcggcattctgcccggttaacagtttctccataaactgcccttccagccggatgacgttcctcatcagttcaggcagtcgcttcgttgaaaaccgccgccacaaaagcattgttcccaacagcccgatcacgctgccgacagctacatcagtcagcctcgctatcataaaataaccggcacccgcgccgccatgcatactttctgtgataacaagcgcatttgcggttaaaaagggaacagccagcgcataattgcggacgatcagcatctcaagaagacattgcagcgctgcaatacaaaacgcaatataaacaccgcccggcttaaaaaacaggattgcgcctgccagcataacaccgatcaccgttccggccgaacgctgaatagccctgtgaagcgtaaaaacaacagtagtgccaagcatgaccgctgctgccgaaagcggaatccaataggagcgtgcaaagccgaatacgagggcaaacatatcggcggcaaacagaacaattccgtactttaacgctctaattaaaactggagacttccagtcaaaagcatttctcaaaaagtaaaaagaggatggcaggcggctcggctccccgtcaagctgcttatcaaaacgttctgaagcgatattcaaaacctcattgatttcttcaaacagcttccgcctaggctcagattcgttctcattaatctgaaacgtaccggaaacccgtgcatgcgcaagcatatctccggtttggcgaattgccttttcaatctgcgcggtctctctgtccggcgtttcagctgaaaaatgaataatggcaaggaatatgtcgtcagctttttcaaggaggcggaaaaatcgttcatcatgccgcgattttttccgtctgttccctttcccaagaaccgtttggcgggctgttctaagcatgagcacggtctgatgctgtgcgttatgaaaacctggcgttccgacggctgaaagacatgcagccagctgatgatatgttttttgcagcaccgctccctccggtccatgtttgttccataaccagccgattaaagcgatacccatggcgaaaatgccgccgagaaacgtcagtcccgctctgaacagcgcttgtgaaggatcggccggcaagccggaactgactaaaaaggcaaggacaaaaaacatcggcgcagggccttgaatgccgagcgcgctaaaaataaacatcgccgctgcaccgatcagccccaaaacagccgccatcatccaaagcatcccggacaaaagcgtccctaaaccaaatgagagggcaatcccaatagaaaccaagagcagcttcaaggcgcgctttttgtatgattcaccgcccgcatataaataaacaaagcctccgatacttgcagttaatccgtaatccgtgtgacctgccaatgctccgaccagcacaggaaaccctgaagcgaaacctgatccgatagcctttttccaaggaaatggatttgcatgaatgcgaaaggcatccttcacgataggcatgattctttgattgttcgcagcagttttgttcatttgacaaaatccttttcaatgaatgtgtagaacttttcccgtttcttcgctttagtatgcccaaaaacgcggttagcttctcaattggtgcgcccgataaaaaaacagagacttataccgtctctgcttgcatgacatcagtttattatcataaaagcggcacctgtcaggactgttttgtccttctgccttcctttaagagcaggtgaataaaaaataaaggataaatcaatagatacccattaaacagccaccacacaagatcaaagtccctgctgaatgtccagaatgataacgcctgcagacctgaacaacaggtcagcacaagagaaatcagcgccatcagcttccagtcagctcgattcacccgctgtaggtacaagctgtacaaccctgtgacagaaatcaggatatccagcggaaaaaaagaccagttccaagcgatcataaacggatggtcatgatgtttaaaagcccagctttccggtatgagcgaaaatccggctgacagccagtacaagataaaaccgatatcagtcacgagaaaaaacagcttcatatatctcatttgtactgcccgcttttatgtaccggctcagacaccgcagcatgctcgatcaggtttaaagacacaacaccggcaataatcaatccaattgaaatgactttcatgacactcacatgttcttgaaaaaacaaaaaaccaacgactgtaatcaggacaattcccatccctgaccatacagcataagcaacagatacatcaatggatttaagcgtaagcgtcagaaagaaaagactccctccataaaagaaaatcaacagcaaactgggaataagctttgtaaaaccggacgatagcttcatgctgaccgttcccgcaacctcaaacaaaatcgccgagcatagaaacacccaattcatgtcgcatcagcctcctcatcagctgttataccgttaaacaaaacatctacaattgattcaagcacctctcctgtcgtgaactgatgtttcagcggatattcagggtcatacacttgattgatgctccctatatacatgtgaacaaacaggtccggattgatgtttctgattctcttttgctgtttgcactcgtttaataatgctaggacaatcgcccattcttccttaataaacgcgtctaatgtaagccacgcatcgtaatggtatttctttagttcatttaataatcccatgttcagcagttccatcccctgcggaaggctgatcagcatttgtttcaccttttcgagcacatttaaactttcattttcatagatgtctctttctatttgcttcatttcagctataaattgttcgacaaccgcctcaacaagctgatctttagatgaataatatgcatagagcgtccgcttgctcgttcccagcgctgccgccaaatcattcatcgtaaatgaaaatcctttctgcttgatcagccggatggtttccgccataattcttttttccacattaatcccccacttccggtaccaataaaactatttcggtaccaatattatacggcagaaatttatggaaatcaacaatatataaaaaacctctcctgttgggagaggtttaaaagacactgcggaccaaaccgccgtctgcccgaagtgccgcaccattgatcgcagaggaaagcgggctgcttaaaaatgtaacgaagtgggcgatttcttccggacggatcagtctttgaataatagatgtcggccggttttctttcataaaacgtgcctcagcttcttgaacagtcaggttttcaccaggatacagcgagttcagcatggtttccacaccctctgttaaggtagagcccggcatgacggtgttgactgtgacattcgtgccggttgccagctccgccaaactgcgggaaatggacagctgcatcgtttttgtcgcactgtaatgggccatttcctgtgatggcataatcgctgcttcactggcaatgaaaatcacacgcccttcttttttctctatcatgttatgcaaatacctgcgtgtcagccttacaccgctcataatattcacttcaaaaaaacgaaaccattcatcgtcgggaatatcaaagtactccgccggttcaaaaatccctaaattgttgaccaaaatatcaacctctggatatgcctgaaacagctcattgcagccttcttctgttcccaaatcaaatgcagccggataaagaaccgcttcagcatgttgtgttttcagttcatctatcgtttgattcactttctcttcccggcgtccgttaatgatcactgccgcaccttcttcagctaacgaagaggcaatagcttttccgatccctgatgtcgaaccggtcaccagtgcggtttttccttgtaaattcagcttcattattcatccctccgtttttgattcctcttatttattgacagaaatctgattggtgaaacatctgctctgcaatcagtatgaaacagctgggattgaaatggaagtacgcactttttggtgcctgtggtttggagaaaaaataaagcagaacctcttaagaggttctgctttattgtcagtatgtatggagacggtgggagtcgaacccacgtccagaaacatcgattacttaagcgtctacgagcgtagcctgcatatttaggatttcactcatcttcttgcctgcgggctggccttccgagagctagtctgttcatctcttcttacgttctcagacgggaacgcaagcgtagcctacttagatgtgctcttcacagacacataggcaatgtcaggaagagctcgctgcgcttattaggcagctaatgctacgttttggttaaaactgttagttttgccagttatatttaagtgcgtgtttacgagatcgcctctcggctcgcagctcaagctcgatccatccctgtcgaatccgtaacgtccccttggtataagggaaatacgggagaaaatatcaagctctcactcaaactggctatagtcttattataacatgatcacggctcttttcaattgtcaaatccttcaaatgaatggcgtcgtgatctaatcgtgaacacagtatagcacaggcctgaatttcgaatcaagcactatgcctttagaagcctttttgactgtctctaaatgctctttcgatttcccgcttcgcgtccttgcgcttcagatcttcccgtttgtcatagttcttcttcccttttccaaggccgagaagcactttggcaaagccgttttttaaatacagcttcagcggaacgagagaatagcctttttcctttgttaacccgatcagcttattaatctccttgcggtgcattaacagctttcttgtccggagcggatcgtggttatagcggtttccctgctcatatgggctgacgtgcatattgtggagaaacaattctccccgttcgattttggcgaaggaatccttaaggtttacgcggccggcgcgaattgatttgatttcggttccttgcagaacgatgcctgtttcataggtttcttctataaaataatcgtggttggctttcttattttgagataatacttttcctgacccttttggcatgccagaacctcctctctctaaggaaaaactgtccaccttttgcgatacgctctattttaccaaatgtcacgtaccgctacaatgaaaagctgtttccgaaagaaagcaaatagagcgctgcggccctatttgctggttgagctgctatttcttctttttccgtttctgtttcggcgcattctggaagccgcgttttttctttttcttcttcggcttagtgaaccactcccctttttcctcagacggagctggagaaacaggtgtattggtgctttggacacgttttctggcaggctttccgcgttttctgctccggctgctgtccaattctctcggacgccgcggagtgcccttcatgccgacaatttcaaagtcgatattgcgctcatctttattgacatcgacaaccttgactgtgatttcatccccgatgcggaagacgttgcctgtccgctcgccaatcattgcgaaatgctgttcgtcaaagcggtagtagtcatctgtcataaagctgacatggacgagtccttcaattgtattcggcagctcgacgaacattccgaagtttgtcacagagctgatcatgccgtcaaactcttcaccgattttatcaagcatgtattccgcttttttcagatcatccgtctcacgctcggcgtcaactgcacggcgctccattgatgatgtatgttcggcgatatccggcaggcgttcagcccacttttcctgagtcgcttcatcgactttgccgttgatcaaatacgttcggatcaggcggtgaacgattaagtccggataacggcggatcggcgatgtgaaatgcgtatagaattccgttgacagaccgaagtgccccaagctttgcgggtcgtatttcgcctgtttcatcgaacggagcataacagtagatataaccgtttcctctggtctgtcacgcacagcgtccagaatgctttgcagcgcgcgcggatgaatatttcccgccgttcctttcaccacatagccaaatgtcgtcacaaactctaaaaacttttgcagcttttcagcattcggctcttcgtgaatccggtatataaacgggacgttcatccaatggaaatgctccgctactgtttcgtttgccacaagcataaattcttcaatcagcttctcggcgacagagcgttctctgatcacaacgtctttaactgctccttcgtcatcaacaagcacctttgcttctttgaaatcaaagtcaacggcgccgcggtccatccgcttatcgcgcagaatttgagccagacgctccatgtctttgaacatcggaacaagaggctcgtatttttgtttcagctcttcatcatcgtcaacaagaattttattcacatctgaatatgtcattctttccgttgttttgatgacactttggaagatctcgtgctctgtcacctgtccctgactgttaatggtcatttcacaagaaagcgtcaggcggtcaacctttggatttaaggagcagatgccgtttgacaatctgtgcggaatcatcgggatgacacggtcaaccagatacacacttgtccctctttcaagcgcttctttgtcaatcggcgagttttcagttacgtaatggctgacatcagctatgtgaacgccaagcttgtagcttccatcatcaagtttcgtcacggtaactgcatcatccaaatccttcgcatccgcaccatcaatggtgacaatcacctggtcacggagatcacggcggtctttcagatctttttcatcaatcgtgtcaggcgtacttgatgcctgttccatcgcgtcagctggaaattctcccggcaggccgtgcttatgaatgaccgataaaatatcaatgcccgggtcgtttttgtggcctagaatggtttcaacctcaccctctgcgttcatgcggccttcaggatagctcgtcagcttgacaacaaccttatgcccttccgcagctccatttttcccatttttcggaatgaagatgtcactcgtgatttttttgtcgtccggaatgacaaagccgaagtttctcgtttctgtatacgtgccgacaacccgctgaatcgctctttctaaaatccgtatgacggttccttcctgcctggagccgcttgactgtgaatttagacgcaccatgacgatatcgccgttcattgccgtatttagctcattaggcggaataaacacatcacttaacgacgtatcttcaggcagcaaaaaggcgaatcctttcgcatgcgctgaaatctttccttttattaaattcatcttctccggaatgccgtaacggtcgcttctcgtccgtacgataaggcctttttcttccaaggcgactaacgctttgacgagctctttaaactcctcggcttccgtaatatttaacatctcctcaagttcctgaacggtcagaggtttgtacgcctcttccttcataaacgagagaagcttttccataaatgcttctttttccattatccgacctcctgttgattaccaatcgagcttctctaaaaattcatacacatcctgatggacgaggtcacgttctttgtcgagtgtaatgacatgccctgattcctcgtaccatttcagctgtttatcatcagtttccacttcgttgtaaataatattggcgctttcggtattaatcatgtggtcatgacgggcctgcaccacaaatgtcggtgaataaatcatatcgacattattccgcacatcagcaattaagtcttgcagcgccttgagggtattcatcggcgttttttcgaattctttcatttcctcttcaatttgctccgggcttttcccctcaaactttttgtaattgcgagcgtatgaaagaacgccttgatacatgacctcttcactcttaatatgcatcggtgcgcacattgggacaattccctttatgggtacagtgtaacccaatttcagcgaaaaaaccccgccaagcgacagtccgcaggcagcaatgctctcatagccttcagattttaagtattcatagccatccattacgtttttccaccagtcttcgggccccgtatgtacaagttcttcaggcgggacgccatgtccttcatattgaggcgcgtggcacgtatagccgcgttcattcaaatatcgtcccagcatccttacatccgctgtattgcctgtaaagccgtgcagcaaaagcaccgctttgtctccgcctttaaatgtaaatggttttggtgtcacaactttcatgctcatgtctccctttctatctgcacgatcattttagttttccacagtttaatcagaaaaaaacgttttgaatatcatccagaaacgtgaaaaaggcctgacttcacatcagaccttatacaaacattgccctataggatataagcaagcgcaatcgttaacacgaaaaacaagactgccagcactaccgtaatgcggtgcaaaattaaatcaagacctcttgctttttgtttcccgaagagctgctccgctccgcctgaaatcgcaccagataatccggcgcttttactggattgaagcaaaacgacaataataagtgcaatgctgacgataaccaataaggtaatcaaaactgcgtgcatcccatacacctccagactcactggctacattacttctattttacatgaaaagggttggcatgtcacgctgtatcagacgccaaaaggccggataagacgttttatcttggttaccctattcatatgaaaaggccaaaggagaaaagcgatgccgcttatcagcatagacagcaggaaacatcttttttatgaagaatatggacagggaatccctatcatttttatccacccgccgggcatgggacgcaaggttttttattatcagcgccttctatccaagcatttcagggtgatttttctcgatttaagcggccacggtgatagtgatcatatcgatcagccagcgtctatttcctattacgcaaacgagatcgcgcaattcatggacgctttgcacattgataaagctgtgttattcgggtattctgccggaggcttaatcgcgcagcatatcggcttcacccgcccggacaaagtgtcacaccttattctgtccggcgcctaccccgctgttcataacgtaatcggccagaagctgcacaaactgggaatgtatctgcttgaaaaaaaccccggtttgctcatgaaaatcctcgctggcagccacacaaaagacagacagcttcgcagcatattaacagaccatatgaaaaaagcagacctggcccattggcatcagtattatctggattcgcttggctacaactgcattgaacagctgccccgcctagaaatgccaatgctgtttatgtatggcggcctgcgggactggacctttacaaacgcaggctattaccgaagatcgtgcagacatgccgaatttttcagattggaatatcagggacatcaattgccgacaaaacaatggaaaacgtgcaatgagctggtgacagggtttgtgctgacacatcattcaatatagaaaacgcttggatctcctttcgttttctatattttattgacttttgtcaacaaaatcatagtaaaaaagatcctcaaatttcaaattaaaatagtgaagcattttaccgatcacaagctgccccggccgtctttctccattcagcacgcggctcagtgtggcgggtgagactccgatttccagcgcaagctgattaagggaataatcgttattaaccatatactgcaagacataatcacgtctaatctgtatcttttctactggcactttcctcaccttccattcctgaaaaacttttttctatacttttacattacggcttatgttaacttttgtcaatacatttccagtctacctattccctttagtcaataaacatactaaaatatgagtaacagtgagggacggggtgagatatatggaaagctttggcgaacaattacgggcattgcgtgaagagagaaagttaacagtcaaccagctggcgacttattcaggcgtaagcgcggccggcatctccagaatcgaaaacggaaaacggggcgttcccaaacctgccaccatcaaaaaactggcagaggccttaaaaattccttatgaggggcttatgtacaaggctggttacatcgaagaagtgcatgaagccagggccccttatgaaacgaagtgcaagctgcttgaaaaagcggaggcctatgacctgaaaaaccttgcgcttcttgagaacgaaaagtggcaatatctcaataaagaagatttgctcatgctggatcattatttttcgtttatttcagacgaagccaaaaaacggtctgctgatgactgactcttgatagaaatgtgaggcgatagaccatgtcaccgttcggacagcaattacgggagctgcgccgcgcccgcaaactgacagtgaatcagcttgcggtgtactcaggcatcagctcggccaccatttcaaaaattgaaaacggcaaacgcgggacgccaaaacccgccacgattaaaaaactggcagccgtcctgaaagtgccgtacgaaaacctaatggccgccgcaggccatattcaggcctttcctgaagaaatccgcgaagcatctgaaagctatcaatccgtttatgatatttaccagacagctgtcacgcgcggagcggagcacctcccgattttcaatagtcaaaaatgggaacatctctcaaagcaggatattgaaaatctcagcaaatacttcgattttttgtcttcagaagcaaaaaaacgcgcctcttcctcataatcccctgtttctctttctatattttatcaatcacgcttgcataccctccctcgttatttgcgttataatagtgacagacgaggtgaaaagtatgaaccaatcagaaatgtgtcctagatttgaaaaagcagtcgacatcttaagtaaacgctgggtcgctttaatcgtatttcagctcttgaacgggtctcagcgatttagcgaaattgaagcagcacttccaaatctaagcggcagagttctgtcagaacggctgaaagaacttgagcttgaaggagtagtgaagcgggatgtcatccctgaaactccggttcgcatcgaatattcattgactgataaaggaaaggcactagcacccatattaggtgagatttctaaatgggcgactgaatggattgacccttcctttcttgactaattgctaaaacggttctgatctcaaagacgagaaaagagccgttttttattttttcccaggtgaaaaaacgatttctcagccgatatatagtacatccacacattacgtttttaaaggagaccactatatgcgactgacgatttcccgcaaattcagcctggtatttttgacactgatcctgatcaatttacttgtaggcggaataggcgttcttaatatgcagcatatcattcaaaaaacagatgaaatcaacacaaaatggattgacggcatcaaaggaatcacttcaattaattatgtaaccgagcacctgtcttctaaagaaaaggactttctgatttatacagacaaaagcaaaatggatacacttgatcaagaaatgaatcaaatcatggaagacattaaccaaaagctcgataactacgaaaaaacgatctccactgataaagagcagaaactgttcgagcagcttcaaactgaaatgaacacctatatggatattcatgcgcaaattatcgaaagcggccgcacaaatgacatggacaaagcaagaggtttattggtccaaactgaggccagctttgaggatatgaaaaaaacaatcactcagcttgttgacttaaatcaagaaggcagcaacacagcggtaaaagaaacgaaggccgtctatcataaagggctcatttacactgctttgcttgtggcagcatcgatcctcatcagcattttcatctggctttatatcacgcgaaacattgtaaagcctatcattcgcatgaaggaatctgccaatcatattgccgagggagacctgtcgaacgacatggagccgctcaactcaaaagacgagctgggtgatctaaatgaagcgctgcaaaaaatggtagggaatctgagagatattgtcggatattctaaagacatatcaagccgggttctttcttcttcgcaggtgcttgcaaccgcaacgaatgaaacaagatccggcagcaaacatattactgaaacgatgaacgaaatggctgagggctctgaacagcaggcccaagacgcggtgacgattgccgaatcgatgaatgagttcactgaaaacattgataaagcctataatcacggcatcacaatcagcgatacgtctcaaaacgttctcgaactcgcagtaagcggaaacgaaaatatggctacgtcattacagcaaatgaaaaccatccatcatattgttcaagaagccgtgcataaagtgagatcactggaacagcattctcaggatatcaacaagctcgttcaggtcatcaacggaattgccgagcaaacgaatttgctgtcccttaacgccgcgattgaagctgcccgcgcaggagaaagcggcaaaggcttcgccgttgtggcagaggaggtcagaaagctggctgacggcgtttctgattccgtgcaggatattacccggattgtaggcgggacacagcaggagatccacactgtcattacgtacttggaaagcagctttacagaagttgaaaaaggaacggaaaacctgacagacaccgggcaggctatgcggcatatcaagcaatccgtcactcatgttgcagacagcattaaggaagtaacggatggcctgaagcagttaacaaaccaatcgattaccatcaatcaatcgattgaaaatatcgcttctgtatccgaagagtctgccgccggcattgaagaaacattttcaattaccgagcaatccgcccattcgatggatcaagtgcttctaaatgctgaagagcttgagcagctggccaatgagcttaatgagaagatgggtcagtttacgatttaaatagaaaaaagaggctggactccagcctctttttctattctatgcagctgattgaacatgtttcgccccggttctttttttcttcaccggacttaatgcccgctccagccaagccatgagcaaatccgcccctaccgccatcaccgcagttggtatcgctccggctagaataatcgcagttccgtttgttgcgtttgagccgcgtacgatcatgtccccaaggcctccggcaccgacaaatgtgccgatcgctgtaattccgatggcaatgacgagagccgtgcgaaggcccgccataatgacagaaagtgcgagcgggagctcaaccattctgagcacttggaatttcgtcatgcccattgcttttccagattctaagtaggcatgttcaatactgataatgcctgtgtacgtgtttcgaataatcggcagcagggaatacagaaataatgatagaatcacggtatttgcgccgagccccataacaagcattaagacggccagcatagcgagcgccgggattgtttgaataacgtttgttacggcaaacacccaggctgacaaacggcgaaaatgcgcgatgaggattccggccggaaccccgacgacagcggcaaataaaacgccgtaagccgacatgagaaagtggcggccgaattcatccatgacgtaactgccattctgcgcgtaatacgtcattaactgttcaagcacgttcattgacctcttccccctttcacgattcgaagtagtgatgtttttctaaatattccttggcaacgacagacggttctttgagattgccgtcgacttcatagttaagctcctgcatcgtggctgtgtcgatttttccgagcattttcttgatgatgccttcaagctcaggatgttctttgagcaccttttccggaacaaccggagagcagtcgtacggcgggaaaaattgtttatcatcctttagcattttgagaccataggacttgattcttccatcggttgaatacgcaagcacaatgtccatttttccgcttttcaccgcgtcgtacacaaggccgatctgcatcggatacgtgccgccgaatgtcatgccgtaggttttcgtaaaatcctgatagccgtttcctttgagcttcatccaatagttatcaacgcccagctttaattgcggcgcccattttttaacgtctgatacggtctctaaatggtattggtcggccagctccttgctgactgtaaaggcatatgtattatcaaacccgtaggagtcataccactttaaatcatatctttttttaaactcccgctgagtaagcgccagcgctttgtccggatctttttcaggttccattctcaacgtgcctgtcagcgcgtctcccgtatatcttgtggccgcaatgtcgatttccccgttcattaaagcctgctgctgcaccgcgttggagccaagatttttaatcgttgttgttttgagatcagtatggtgttcgatcaactggccaagcatgctggcgatgatttctgattcgctcatgctttgcgcgccgattttaatggtctggtctgcagcagcgctgagaccaggaagcgaacagccgctcagcgtcagcgttgccgcaagtactaaacctatcattaatttgagatattttcttttcatgagccgcctccttatgacaattccttcaatctctgcatgccggcaggtgtcagttttcgttcagcaactgccagcacataatcaatcacaattgccaatatcgtgacaggtaccgcgcccccgatgatatattccggctgatataaattcagtccgataaaaatgtaatcacccaatccgccgcctccgataaaggaagcaagcgtggcccagccgattaagtaaatcgtcgatgttctgattcccgccatgattactggtgcggcaagcggcagctccaccaagcggacttgttcagccggcgtcattccgattcctttaccagactcgagcagatttttgttgacgccgcgaatgccggtatacgtgttgcgaagaatcggcaatacggaatagaaaaacaaagccacaatggccggaaccttccctacaccaaggagcggaataaaaaaagcgaggatggccagactcggcagcgtctgaatgatattgacaatgccgataatggtgccggctccttttttcattctggtaagcacaactccgagggggacggcaaccagcacacctaagatcacagcaatgagcgatatcgtaatatgctcgtatgttttataaagaagctcgcccccattggtttgcaaaaattgaacaatatgatgcatgacttatcgcccctccctatgacaatgctgcgagttgcttttcttctccccagagggagtcatacacgatgtcgaccagacttgccctcgtcacaattccgatcaggcgtcggtcttcatccacaacgggaacatatttgacaccccgttttaaaattttgcggaccgtgtcgcgcagcagtgtgccgcccagtactgtgtatatatcttcatgtaaaacttcactgacgagattggcctttttccggcattgatcaatgatttcaacatcgacatagccttgcagaacgtgcttgtcatcgacgaccagcaatgaatcgacccgttcctgcctcatcagctgaatggcctcagaaagcgttttatccgcggtgatcgttacaggctgtgtgttcataatctggtcaacccgttcaacatccgggctggatgactgaatcagccgctccttgccgataaattcctcaacaaattcgtctgccggatttcttaaaatgtcatcgggcgttccaacttgaacgatttctcccgcttttaaaatcacaatccggtctgccagcttaatcgcttcatccatatcgtgggtaacaaatacgatggttttatgtaaggttttttgcagttttttaaattcttcctggagggaatccctcgtaatcgggtcgagtgccccaaacggttcatccattaagataagcggcggctccgcggcaagtgcccgtaatacaccaattcgctgctgctgccccccgcttaattcatgagggtaacggtctacatattctggccccatatcgaccaattttaaaagctcacgcgcccgctctttccgctgctgctccggccatttcagcagttttgggacgagtgagatattctgctgaatggtcatatggggaaacaggccgatctgctgaatcacatagccaattttgcgcctgagctctacaggatcctggtccatgatgttttcgccgtcaatgaaaatctttccagcggaaggctcaattaatcggttaatcattttcattgttgtcgtttttccgcagccgctcggcccaataaagcagataaattcgccttttgcaatcttaagatttacgttgttcacagcttttttgccgcccttgtatgttttcgagacattttctaatgtcagcaaacatcgcacctccaaaattaagtttattcaatttgttcagtttaaatttaatttttcagacaattgaatgcttcccattatagaataaagtttataaaataaaaagtttacaatttgttcatattatttataaagtatgtgtaaacgctgatttacccgcattgacgtgtgttgatctccttattgctccaatttcctgccaaattctcttttgacagcattttcgccgtatcaaaaatgtggtatattgacatcggaattgttagctgaaaggatgaaaccgttggagaaagatccgttaacgatcattgaacaagccgaggaccattttatagaaagaatcgcggaaaacatgcatgcatttggaatgccctctaccgtcggacgagtgctgggcattatttatatgaatcgaaaaccgatgacgcttacggaattatctgaggccaccggcatgagtaaaacacgtatgagccaggtagtgcgggaaatgcttgatgccaacattgccgagaaggtattcgaaaaaggcgtgcgaaaagatttatatgaggttgagcaggactactatcaaacatttatcacgctgttttcagccacctggagcaaagtcgtcagcaaaaacaaaatgatgcataaaaaactcaatcgggagctgcttagcgtgttggatgaagagcttactcctgaagtggaagaaaaagtgaatgagctgctgaaggaattaaaggaatggctcgattattataattggctcagccgtttgattgagttttttgagagcgaagacatttttaaatatgtgccgaagccgtaaaaaacgccctgtcattacaaggcgttttttcttatgcggcacctgccaagtttttcttctttctctttttaatcgggcttaatgctcgttcaagccagcccatgaccaaatcggcaatcaccgccatcagagctgtggggatcgctcccgctaatataatcgcggttccgtttgtggcgtttgatcctctgacgatgatgtccccgagaccgccagcaccgacaaatgtcccgatggcagtaatgccgatggcaatgacaagcgcggtgcgcaggccggccattatgacagaaagcgcaagcggaagctcgaccatccgcagcacttgaaattttgtcatccccattgcttttccggattcaagataggcgtgctcaatactgataatcccagtatacgtatttctgataatcggcagaagagaatacagaaataatgacaatatcaccgtattagcgcccagccccatgacaagcatcagcacggcgagcatggcgagagccgggatcgtctgaatgacgttcgtgaccgcaaaaacccatccgcttaatcttctgtatctggctatcaggatgccgagcggaattccaacaatggcggcaaataaaacgccgtataccgacatcagaaaatggcggtaaaactcctgcagcacataaccgccgttttgcgaatagtatgtgccaagctgctgtagtacttccatatgatccacctcttttcttagtcaaaataatgatgtttctctaaaaattcctttgctacgacagacggctccttcagcttgccatccacctcataattaagttcctgcatcgtttccgtgtcgatttgcccaatcagcttattgatcacaccttcaagttccggatgctccttaagcaccttttccggaatcaccggtgaacagtcatacggcggaaagaaacgcttatcgtcttttaagattttcagatcatatgctttaatccgtccatccgttgaataagccaaaacggcgtccattttccggtttttgactgcgtcatagactagcccgatctgcattggataagttgtgccgaactcaaagccatatgtgctgacaaagcctttatacccgtcgccttttcgtttcagccaagcattgtcgacgcctaatttatattgggaagcatttttcttcaggtcagacacggtgttaatatgctccttttccgcaaacttttttgttactgtgaaggcatatgtgttatcaaagccgtaggaatcaaaccatttataggaaaagcgcttttgaaactcgttctgcacaatgttcagcgcttttttcggatctttctccgcttccttgccgagggtgcttgttaaatctgttccggaatagcgcgtggctgaaatatcaatgtcaccgcccagcatcgcttggtgctgaacatagtttgagccgaggtttttcactaaagcggtattcaaatctgtatcatgttcaataagctgcgcgatcatattcgctacaatttctgattctgtcatgctttgcgccccgattttgatcgtgtcgtcagaagcgccgccgagacccggcagagagcagccgcctagcagcatgacaaagacgagagcaaacgcgccaagccatttgatttttgtcattttcaacagtgccaactccttacgaaacttccttcatcccttgcaagcctttcggcgtcacctttcgttctgtcacagccagcacataatcaataataattgccagaattgtgacaggcacggcaccgccaatgatatattcaggctggtataggttcagtccgataaaaatatagtccccgaggccgcctcccccgataaacgacgcaagtgtcgcccagccaattaggtagatcgttgatgtgcggatccccgccatgatgatgggaatcgccagcgggatttcgacgagccgaatctgctcccagccggtcatgccaatccctttccccgattccaggaggtttttatttacacctttaatgccggtatacgtattgcgcaggatcggcagcaccgaatagaaaaataaagcgacaatcgcaggcacttttcctacaccgagaagcggaataaaaaaggctaaaatcgccagactcgggagggtttgcacaatgtttacgaaaccgattaccgcacctgcgccttttttcattctggtaagagcaacgccgagcggcactgcaacgataatgcccaatacaacggctatgagtgaaatatataaatgctctcctgttttatacagcagctctccgccgttcgtttgcaaaaaagtcatcatttgattcatcttaaaagagctcctcccctggtcagatcgtcatgagctggttttcctcgtcgccccaaatggaatcgtatacgatatcaacgaggctcgctcttgtcacaatccctgctaaatggttctgttcatcgaccaccggaacatacttgatcccctgcttcaaaatttttcggactgtatcgcgaagaagcgcccctttttgaacggtatatatatctgaacggtatacatcgccaacgatgctcgcttttttgcggttttgatcaatcatttccacatcaacatagcccttcagcacgttttgccggtccacaacgagcagcgagtcaacacgtttttctctcatcagctgaatcgcctgagaaagtgttttgtccgcagataccgtcaccggcgttctgttcatcatttgctctacccgctcgatatccggtcttgactgaatcaggcgctctttcccgataaattcttcaacaaactcatttgccgggtttcgaagaatctcatcaggtgtgccgacttgaacgatttctcccgcttttaatatcacaatcctgtcagcaagcttaattgcttcatccatatcgtgggttacaaacacaatcgttttgtttaaggttctctgcagttttttgaattcttcctgaagggaatcacgcgtaatcggatcaagcgctccgaacggttcatccattaaaatgagagggggttccgctgccagggcgcgcagcacgccgattctctgctgctgtccgccgctgagctcatgcggataacggtctaaatactctgggcccatatccacaagctttaacagctcgcgcgcccgttctttccgtttttcctcaggccatttcagcagctttggtacgagtgagatgttctgctggatggtcatatgggggaacaaaccaatctgctgaatcacatagccgatttttcttctcagctcaaccgggtcctgttccataatattttctccgtcgataaagatccttccagacgatggttctatcagtctgttgatcatcttcatcgttgtcgtttttccgcagccgctcgggccgataaaacagataaattcaccttttgcaatatctaaatcaatgctgttcacagcttttttgccgcctttatatacttttgacacttgttccaatttcagcaatccgtgcacctccgcaggtttcctttaaattttctgaaaagtataatccttattatagtttgaactttgtaaaataaaaagtttacaatgtgttgaaattatatgttatttatagattatttattgttatgaccgagacggaaagggtgttcttacaattacgccggatacctcccacttcctctgcattcagctattttcaacaccaggaagaaatatgatatattgacaccatcaattgccatttgaagggatgatcagctgtgaaaaaaaccgctctcaacatcattgaacatgctgaagagcatctcattgagaagattgccgaaaatatgcatacgtttggaatgccttcaactgtcggacgtgtgctcggaattatttatatgaatcgaaaaccaatgaccttaagcgagctctctgaggcaacgggcatgagcaaaacacggatgagccaggttgtccgggaaatgatcgatgccaatatcgccgaaaaggtgtttgaaaaaggcgtacgaaaagacctttatgacgtcgagcaggattattatcaaaccttcatttctttatttgcggcgaattggacaaaggtcgtgagcaaaaacaaagtgctgtataaaaaattaaaccgggagctgagtgatcttttacaaagggacgggcttaccccggaagcggaagagaaagtcaatcagctgctgaatgaattaaaagaatggcttcattactatgattggctgagcaggttgattgaattttttgagagtgaggaagtctttcggtatgtgccgaaaacaaaagaatgcagctctctaaaataagagagctgctttttgcatcatgaggttaagaccggaaacatgcctttcagcccggcaccaatcatcccgaccgcaaccacggctaagattaatcccatcagtctggtaatcacattcatctcggtttttccgagtttgctgctgataaaagcagaatagtggaaaaagagaaaggtcagggcaataacggcggctatgccgatcatgacagccgcataatgaccaatgccgctatgtccggcggaaaggctcatcactgttgcaatcgttccgggcccagcaatgatcggaatggataaaggtgtgactgatatatccgctttttccttgctttccttatgttcatcatggtgaagagattgcacgtgcgattctttcgcattcaatagattataggcaatgccgaaaatgaatatgccgcccgccactcggagcgcgtgaatgttgatatcaaacagtttaaagataagatgaccgaaaaccaaaaaagctgcgagaataaaaaaggataaaatagctgccttccgggcaatcgcttttctttccgctgcagtatagccttctgtcagcgtcagaaatatcggtacgtttccgatcggattcgatactgcgaataaagaaatgaagacgtgaacgataaatgagaacatcatatacctccttgttgatagtctctgcacaggaaatagaattattctccacccttttacccggaggcgatttcccggtaaacctttatagcctgtcagaaacgcgccatgctacaatgaagtgacaaattgaataggaaggacgtatacagatgttcaaaaaaattgcggcagatgccttgggcttatctgatatcggaaaaattatcgaacctcaggactatgacaaaacagacgcagatgactatgtcatgcatgaagataatgagaaaatttatttcttgattaaaacaaaagcagacgagtattgctttacgaacctggccctgatccatgtggacggcgaacgcgccacttcctcaaaacgaacgttgaaacgctatccttattcgcaatataaaatctctgacgtttttcttgaaactgccggaaaagtggatttggatgttgaaattaagttcaagctgggcggtgaacaattcgacattgatgtccacaaagaccagattgaaaagttaaaagacctttataaagcactgcttcgcatcgctgaaacaacctatgaaaatgacattttaatcaatcaagcggagcaaagcttagataaagcagtgacgattcttcaccatacccgccctgagcacgtcaatattgaaacgcaatacaaagagctgaccgaattcggattcacttggctgacatccgttcgctcgcagtatcatattaaggattttggggatgtatttgagaaatatattaataactagataaaaaaagacacagctgctatcgtgctcgtgtctttttttgtataatattgattactttacaacttttttcttttataataaaactattagtctattttccctatattacagataaaggagttattttatgtattgtcctcaatgcggccatcaaacagatggcggaaatttttgtgagaaatgcggatcaccgctccccggtcaatcaggccaccagcatgcagctcaaactggagccgctgcaaagcaagcagcaaaacagttcggttcatttgtcttatccgtcctgaaacgcccttatcaggaatgtaaagcaacaggcggagagcagttgatcagcgcggtgattacgctggttcttttcagtttgctgacccctttgatgttttatattcttttttcagacggtcccggaagcgtaagctttacagcaatcttcttagagccaaccatttattttattttatttctatttggcctgcatgcatgcatctttttcgccctgaaaatcgcgggaaaccaagtatctttcaaggattcattctcaagattcggagcgtttctcataccgtttacggctattttgattcttgcccttttcttctttttattacatacagacatttgctttactatattagccgttggtttaatcggtgcattcttcgccattcctcctgcgatgctgagcagttaccagcattcatataaagggaaggttgatgtcatttactcaacgattgtaatttatctgatcatctgcgttacatttcagcttattatcgaacactatgtcaaagaaattttccgatatatgctcttttaaaaacaaccccatcacctgctggtgatggggttgttttattgaatagacgttaagtaaattcttccgttcttcactacgccggtataagtccagttatatgttctgagctttggactgccgcctgattttgtgatatagaattcttcatacgtcttaatcgtgatagccgacccattttggctccagcttttcacttcatagttattaaagtcttctgttgtcccctctttatttaatttcgacacgagatgctgctggtcggaataaagggaactgcctttttcaaggctgtcttccatcagtgagaaattattttgattcacggcatctgcctgactttgcagataactgcccataaataatgtcacttgttcatctgtaacatcgccgcttgcagagctttcactgcctttgtttttcgagccagcccaggcggaagtgtatgtctctggtttatcatttttgattttctttatatttgtgcctgcagattggaatgttgattctgcatcttcgaaaatccactttttctgttttttatcatatgaaagaagatattcataactcggactttcgtcagtcatttcagattttgtatagtcgttatacgaagaagactggtgaagttcttttcctgttaccgatacctgccacgttccgtcgtttttctgagagagggcaaatgtgtccaggtcaaaatcagtttccaagtatctatcttttaagtatgaatccgcgcttttcatagaatcgacggtgtccttcgtctccgccttccaattggcacttgcctctgtcatctgggctgtattcccatcagatagagctttggagtattgttttgttgttttgacaattgtgttcataatctgttcctgtgtatcttgatcaggaattaacgttaactccatttctttatcatcgatcggaacgccggcagtttttgtttttccccacggaaattctgcctcgactgaagctgtcattgatccatctgtcagcagcggaccatatgttacggatttgaacggatctttatgaattgatttaccgttaatcagcaaatctcccttcccgctcttgatgtcatccgctaagctgaatgtcacatcgtctgcttccaatgagagatcaacacgaaagctgctatcgccaatcgcctgaatgtcttcctttttcacaaggtcaacgacatcgtttttcagtttggctgagactgtatattcgccgggaatgtacggaccgagggtttgtgcttgatctgctttctttacagatccggcttcctctttattgacatatagatcggtatttttataattgctgctcacttcaaaataaacaggtgctacctttaagtcataatggtcaaataccagcaggcttttcccgtctttttccgcatatacgatatccttctgggctgtttcatcacgcagcgatgcaaaaagttcatcttttttgtctggatgatccttcaaatatgtaagaaacggttttacattatttttagtgagtttaagattgtcatttaccggtgtaagcagagtcgcgatttggtcctgatccccatcatttacggcctgttcaaacttgtctactaacctatcctttgaagtaaaatacgctccggttttatatgcggcgaataatataacgcacgccgcggcaatgctgctccataaaatgatggttttcttagggatcggttttcgcggagcctgcctcgtttctgcagtgctagctgtttcttgatttgcctgtttgctgccccctccgatcggggtgccgcattgtttacaaaacttggctccttcattattctgggagccgcaattcttacaaaataacatgactttcctcctattctactaatttgataacatttactgcttttcatattttataataaaacagaatgaaattgggaacgaatgaaaaaattaaatgtctaccagactaaaaaggtggaatgaatatgcaaaagctcaggattgaattaggagaagaaacaaatgacgaattatatgatctattgctgctcgccgatccatcgaaagacattgtagatgaatatcttgagaggggagaatgttacacagcttgggccggtgatgagcttgcaggggtttatgtattgctaaaaacaaggccgcaaacagttgaaattgtaaatattgcggtaaaagaatctcttcagaagaaaggctttggcaaacagcttgtacttgacgccatcgaaaaagcgaagaagctgggggcggacacgattgaaatcggaacggggaattcgagcattcatcagctttccctctatcaaaaatgcggattccgcattcaggcgatcgaccacgatttctttctcagacattatgatgaggacatttttgaaaacgggattcaatgccgcgatatggtaaggctttatttggatctctgaaagcataaaaaagccgccgagagaaaatcccggcggtctttttattacttgtttaagttgtagaaagagttgataccgtggtattgagcagtttcagccaactgatcttcgatgcgaagaagctggttgtatttcgcaacacggtccgtacgagacggagcacctgttttgatttgtcctgcgtttgttgccacagcgatgtcagcgattgtgctgtcttcagtttcaccagaacggtgagagataacagctgtgtagcctgcgcgtttcgccatttcgatcgcatcgaatgtttcagtcaatgtaccgatttggtttactttgatcaggatagagttgcctacgccgtttttaataccttcagaaagttttttcgtgtttgtaacgaagaggtcgtcaccaacaagctgaacttttttgccaagacgctcagtaagaagcttgtggccttcccagtcgttttcgtcaagtccgtcttcgatcgagatgattgggtatttagaaacaagctcttcataccagtcaaccatttcagcagatgttttcacaacgccttcgccagacagatggtatttgccgtcttctttgttgtagaactcagaagatgcagcatccatagcaagtttaacttcttcgccaggtttgaagccggctttttcgattgcttcaacgattgtttgaagcgcttcttcgttagaaccaaggtttggagcgaatccgccttcgtcacctacagcagtgtttaagccttttgcgcttaatactgatttcaggctgtggaagatttgagcgcccatgcgaagtgcttcacggaagttaggagcacctacaggcatgatcatgaattcttgaatatccacgttgttatcagcatgctctccgccgtttacgatgttcatcatcggtacaggaagcgtttttgagttgaatcctccaaggtattggtaaagaggaatctgtaagaaatcagcagcagcacgcgcacaagccatagatacgccaaggattgcgttcgcaccaagtttgcctttgttttcagtaccgtcaagctcgattaaaagctgatcgattgcgttttgttcagttacatcaaagccaagaagctctggagcaatgatttcgtttacgttgttaacagctgttaacacgccttttccaaggtaacggtctttgtcgccgtcacgaagctcaaccgcttcgtattcacctgtagaagctccgcttggcactaatgcgcggccgaaagctcctgtttctgtatatacttcaacttcaactgttgggttgccgcgggagtctaatacttcgcgtgcataaacatcaacaatgtatggcatgagttttgtctctccttttgattttcaaattatttttgaattaaagatgttcctgtcatttctttcggtttttcaacaccaagaaggtctaataacgttggtgcaaggtcgcctaggattccgccttcacgcagcgtaatgccttctttcgttacaatcacagggactgggtttgttgtatgcgcagtgtgcggttcgcctgattctgtaatcagaatgtcagcattaccgtgatcagcggtaatgatagcgtgtccgcctttagcaaggatcgcgtcaacgacttcgcccaagcattcgtccactgcttcaattgctttaattgttggttcaaccattccggagtggccgaccatatcagggtttgcgaagttaagaatgatcgcgtcatgcttgtcagcttcaatttctttgacaagcgcgtctttcacttcatacgcactcatctcaggcttcaagtcatacgttgcaactttaggcgaattgatgagaatacgctcttcacccgggaattcagcttcacggccgccgctcataaagaacgtgacgtgcggatacttttcagtttctgcaattcgaagctgttttaacccgtgctgagataatacttctccgactgtgttatcaagatttatcggtttaaacgctacatagccgtcaactgtttcactgaagtgagtcaggcagacgaaatacaggttctttggataattctcgccgcggtcgaagtcacggaagtctttgtttgtgaacgtgttggaaatctggatggcgcggtccggtctgaaattatagaaaatcacagaatcgccgtcttggattttcgcaacaggctcaccgttttcttttgtgatgacagatggaatcacgaattcatcgtagataccatttgcatatgaatcatcaacaacatccagggcgctgcggtaagatgggccttcgccgtacgccattgcgcggtacgctttttctacacggtcccagcgtttgtcgcggtccatagagtagtaacgtccggaaatgctggcgatttcacctacaccgatttccttgatttgatcgttcagctggttgatgtacgttttcgctgtctgcggacctacatcacggccgtcaaggaagccatggatataaacctttgtcagcccttcttttttcgcaagctttaacagtgcgaataaatgattgatatggctgtgcacgcctccgtcagataaaagaccgaacaggtgcaaggctttgttgttttctttcgcgttgctgatcgcgtcaaggaatgtttgattgcgttcgaactctccttcgcgaatggcaacatttacgcgtgttaagctttggtacacaatacgtcccgcaccgatatttaagtgacctacttcggagttccccatttgcccttcaggaagacctacagcctcgcctgaagcagtcaatgtttgatgaggatattggttccaatagcggtcaaaattcggttttttcgctaaagcgactgcgttccctactgtttcgttacgtaatccgaacccatcaagaatgatgagtgcagctggttttttactcatattgaccttcctccaataattgaacgaatgactgtggctcaaggctcgcgccgccgaccaaagcaccgtcaatatcggactctgccatatattctttaatgtttgcaggctttacgcttccgccatattggatgcgaagcttgtctgcaacttcttggctgaagctttcagcgacggttttacggatatgcgcacacacgtcattcgcatctttcgctgtagaagatttgcctgttccgattgcccagattggctcatacgcaataacagaagcagcaacttgttcttcagaaagaccagcaaggccttttttcacttggtcagcaacaagatcatttgttttgccggcttcacgctcttcaagcgtttcacctacacagatgatcggcacaatgccgtgtttgaaagctgcgtgtgcttttttgttaactgtttcatcagtttcagcgaacatttcacggcgctcagagtggccaatgacgcagtagtcaacgccaaggtctttcagagcaaccgggctgatttcgcctgtgaacgcgccgctttcttcgaagtgcatgttttgagcgccgacttttaggtcagtgcctttcacagcagaagcaagcttttctaagaaaagcgctggcgcgcaaacaacagcttcagctttgtctgctgctggaatggaagatttcacttcttcaacgaagctgacagcttcgccgagtgttttgttcattttccagttaccggcgataattggttttctcatctgttccacttccttatagcagttttgagattatttatcgttcagtgcagctacccctggaagctctttgccttccataaactcaagggatgcgccgccgcctgttgagatgtggctcattttgtcagcaaggccgaatttttcaaccgctgccgcagagtctcctccgccgatgacagagtatgtatctttcgcctctgccaatgcttccgcaaccgcttttgttccttgagcgaacaagtcgatttcgaatacgcccattggtccgttccacacgacaagtttgctgtttttgatgacgtcagcatacgtttcgcgtgttttcgtaccaatgtcgattgcttctaaatcactagggatttcagagatcggcacaattttcacgtttgcatcgttagagaaatcatctgcaacgagtacatcttcaggcatgtagaagttaacgcctttttctttagcgcggtccataaatgatttcgcaagctcgattttatcctcttcaagaagagatttaccgacttcatagccaagcgcttttacgaaagtataagcaagacctccgccgatgatcaggttgtctactttatcaagaagactttcgattacaccgattttgtcttttactttcgctccgccgatgatcgctgtgaacgggcggtcaggattggaaaccgcttttccaagtacatcaagctctttttccattaagaaacctgcaactgctggcagatgctcggcaattccagctgtagatgcgtgagcacggtgggcagcaccgaatgcgtcatttacatatacatctgcaagctcagcaaatgcttttgcaagctcagggtcatttttctcttcaccaggatagaaacgtacgttttccaatacaagaacgtctccgtccttcatctcagaaatttgtgcttttacagcatcgccgtatgcttcatccgcttttttcacttctttgccaagcagttcgccgagacgtgcagcgacaggagttaaacgaagctcctcaaccacttcgcctttcgggcggcctaagtggctcgcaagaaggacttttgcgccttggtctgcaaggtgtttgattgttggaagcgcagcacggatacgtgtatcgtctgttacttccccgtctttcattggaacgttaaagtcaacgcggcagaatacaactttgccttttacgtcgatgtctttgagagtttttttattcatgcctaggagatcctccttcaaaatggtttgcatacagcacgaaaaacgtgaaaccgtctgttcaagcgataactccgctagggcagatcgcagtctttttcggcacagggcagttcgtctaaaagccagggcagcggccttaggcgaaagcgccggcaaagctgcttaaaacgcggtcgtttctctatcacagagcgttttctgaaagccggtcttcatggaaaaagggaaagggagtccgtccccttcccttgtccgctttcattatagcgcttctattcgaaagaaccaagtcaggtcctttttcagctataaattaaagacctttttttgcgatgtaagctgcaaggtcaacaacgcggttagagtagccgctttcgttatcgtaccaagagattacttttaccatgctgccttccataaccattgtagaaagagcatcgattgtagaagagtttttgtttccgttgtagtcgccagaaactaatggctcttcgctgtagccaaggattcctttaaggtcgccttcagccgcttctttaagagctgcgtttacttcttcagctgttacttcttggttcagttcagcaaccaagtcaactagagaaacgtttggagttggaacacgcattgctccaccgttcagtttgccttttagttcaggaagaactagagaaactgctttagcagcaccagttgatgttgggatgatgttttcagctgctgcacgcgcacgacggtagtctttgtgcggaagatcaaggatttgctgatcgtttgtgtaagagtgaacagttgtcatcataccgcgtttgatgccgaatttatcgttaagtacttttgcaaacggcgcaaggcagtttgttgtgcaagatgcgttagagataacatcgtggttagccgcatcgtatttatcttcgttaacacccataacgattgtgatatcttcttcgttagcaggagcagagatgattacttttttcgcgccagcttctaagtgtttcgcagcgtctgcgcgttttgtgaagaaaccagtagattcaactacgatttcaacgccttgtttgccccagctaagtttagcaggatcgcgttctgcagaaacttcaattgttttgccgttaacaacaaggttgttaccgtcaactgaaacttcagcgtctaattttccgtgtacagaatcatattgtaaaaggtgagccagcatgttagcatctgttaaatcgttaaccgctactacctcaacttcaggattgtttaatgctgcgcggaatacgttacgtccaatacgaccaaaaccgttaataccgacttttactgccatgattgtttcctcctttaaataagtgagagatatttatattgagggattattcatcccttaataacttctttgcggctccttcgtctgtgacgagaaccgtgttgcgtggctttttaaagtaagcctcgatcgcctcggcttttgatgatccgcccgctaccgcaataatatcggggatggcgtctatgtcatccagctgcattccgacagaatgcactttgtgaaccacttcgccgtccgcgttaaaatagtagccgaacgcttccgtcaccgcgtcgttatcatctattttctttaagtcttctaaaggcgtgtttctgcgctgagccatagttttagcttcgccgattccatgaaccagcatactcgctgatttaatggtgttcagcacctctttgacagaaggctcttcaataatagatgaataggcgccttgtgacagctgtcccggaacaaacaaaagccggtaagtgcctgaagccttctccgccatatgcgcgcatatggtgttcgcctggtttttcacgtcttcgcctaaaccgcctcttgcaggcacaaacaaaagctcgcggtttttagaatccggcgtcatcatttcggcgacagcttcaattgtcgtaccgccagttacagcgacgatatttttgcctgaaaatctttttttcatacatgcgacagccgctcttcccatttcttttttgacccatggggattgatcgctgtctccggatacgataatggcatcctttagatttaaacgttcttttaatgtcttttccaaaagagtcaaacctaaaacatctttcatcgtatcttccaaaacagaaagcagttcatagccctcttctgtcaatgtcatgccgtttgtcttaatatcgaccaggttctgttcctttaaaaactgaacctcgcccctcagcacacgctcgctgatttcgagactggcagacaggcttcttcgcccgatgggttctgtcagcctgatatactgcaagatttcaaacctcttttgcataacgagcagaagatcaggcaataattttttttgagcttgtattaactggttcatgactcaaacgttccttccttttttgctggacgttatatgtcccgctatgacaaaaaacgtcccgtcatagccaaaaaaaatcatttctgctttctttaattattttaacagggtggaattgtttattcaactgttaagagccaattcatcgacaatattcgcagagttttcatgccgcgtcgttttatccagcaatattttatcctatatatctttatcttatacagaaagcgccaaatggtgcatcccaatataaacagcccttcccgtagaaagggctgtttcattaaagcgttttcattttatccaaagcttttcaatttcctcgagcgatttgttcttcgtttctggacagatcgtaacgacaaacaggaaacaaaggatgttaatcaccgcaaagatccaaaatgtataggcgagcccgaaagaatcgatcatcattggcacaaactgtccaatcgcccagtttgctccccataaaaagatggtcgcaatgcccgcggcccgcgcacgcagatggttcggaaagatttcagaaatcataatccatgtgatcggtccgaccgagacacagaaagcagcgacaaaacctaatataaggacgatcatcatgatcccgcttgttaactcaaagtaaaacgacgtcccgattaaaatcataaaaatagccataaaagcagaaccgatggacatcagtttttttcgtccgactttatcaatcagcaacaccgcaataacggtaaagatgacttctacaacaccgacgatacaagttgtcacaaatccggcgttttgcccgaatcccatcattttaaagatttccggcccgtagtaagtaatggcgttcatgccgatgacttggttaaagagcgccagcaggattccaatgacaagcgcctttctgagccccggcttaaacagctgggagagcgaccccatttgttctatttttaaagagttctcaatgttctttaattcttcttttgcaacagtttctccattaatacgtgtcaggatctttaaagcttcatttgttttgcccgctttcgccagccatctcggactttccgggacgacgagcaggacaaggaaaaagatgacggacggcaccattccataagcaagcatccatctccagccggtgtgcacgccccattcgtatgttccggaccgctgcacagctagattaataaagtatgtagcggaaatacccagtatcgtaaagagctgatataaggaagataaacttccgcgtatggcgggcggtgccgcttctgtaatatacgtaacagagagcgatgagcccatcccgattcccagccccccgataatccttgcaatgattaaggtggacacgtcttgagaaagcgctgaaacgattgctgatatcgcaaataacaaagcggctgtcattaaaatttttctccggccgaatctgtcacttaaaaatccggatatcccgacgcccacaactcctccaatcataatgcttgaaatgacaagtccctccataaacggactcaggctgtataaatctttcagaaaaccgatagcgccagaaatcactgccgtgtcatagccatacaataagccgccaagccccgccgcacatgagatcaaaatgacaaatcccattgaatggcttcttgttacaggaacatttggttctaattgagttggagtattcttcatttccctgccctcccgaatgttgagtaaagcgttttcatttaaaccttcaattgtacgtacttatattaaaatttaacgaaaattacatttaattagtacgtacaaatatagaataatcttgtttgcattttctgtcaatgttttcttacaaagaacgctgtgatatactgaaatttgtccgtatacattttggaggaatggatatgttaccaaaatacgcgcaagtaaaagaagaaatcagttcatggattaatcaaggcaaaatactgcccgatcaaaaaatccctaccgaaaacgaattaatgcagcaattcggcgtcagccggcataccatccgcaaagcgatcggagacctcgtatcactaggtctgctgtacagcgtgcaaggcggaggcacctttgtcgcttcacgctctgctaagtcagcgctgcattccaataaaacgatcggtgttttgacaacttacatatcagactatattttcccgagcatcatcagaggaatcgagtcctatttaagcgagcaggggtattctatgcttttgacaagcacaaacaacaacccggacaatgaaagaagaggcttagaaaacctgctgtcccagcatattgacggactcatcgtagaaccgacaaaaagcgcccttcaaaccccaaacatcggctattatctgaacttggagaaaaacggcattccttttgcgatgattaacgcgtcatatgccgagcttgccgcgccaagttttaccttggatgatgtgaaaggcgggatgatggcggcggagcatttgctttctctcggccacacgcatatgatgggtatttttaaagctgatgacacacaaggcgtgaaacggatgaacggatttatacaggcgcaccgggagcgtgagttgtttccttctccggatatgatcgtgacatttacaacggaagaaaaagaatcaaaacttctggagaaagtaaaagccacactggagaaaaacagcaagcacatgccgacagccattctttgttataacgatgaaattgcgctgaaggtgattgatatgctgagggagatggatcttaaagtgccggaggatatgtctattgtcgggtacgatgattcacatttcgcccaaatctcagaagtgaaactaacctctgtcaaacatccgaaatcagtgcttggaaaagcagccgccaaatatgtcattgactgcttagagcataaaaagccgaagcaagaggatgtcatatttgagcctgagttgatcattcgccagtccgcacgaaaactgaatgaataaaaaaagcaatgtatgggtctccccgctacattgctttttttatagctgttatctgttgttccaaacgtcagcgatgatttcaaacgaacgcattctgtctgcgtgttcaaaggtttctgagttaaccataatttcgtcagcctgtgtcattttgacgaaatcttcaagcttcgccttcacttcttccggacctccgacaatcgtggagctcagctgctcattgaccatcgctttttcatacgggctccaaatttgatccatatcctcaacaggcggtttaagctggttcggcgtaccgcggacaagatcaagaaacctttgataatgcgaagtcgcaaggtgctgcgctttctcgtttgtatctgccgcgataatggtgacaccgaccatcgcatacggttcgtcgagcacgtctgacggcgtgaaggaattgcggtaaagctccaatgcaggaaccgtattcgctggtgagaaatgagcggcaaaggcaaacggaagacctagttcacctgccagacgggcgctgaagccgcttgagcccagcagccaaatcggcacatctatgccctctccgggaatggcgcgaacttgattgcgcacatttcccttcggtttaaagtaattgcgcagttcctctaattgttctggaaaatcctccccgctgttgatgtttctgcggagcgctctggctgtcaattggtctgttcccggcgcacgtccaagccccagatcaatccgcccgggatacagtgtttccagtgtgccgaattgttcagcaatgactaatgaagagtggttcgggagcataatgccgccggaaccgacgcggattttcttcgtgcctccggcaatatggccaatcaaaactgcggtggcagagcttgcaacaccttctatattatgatgttcagcaagccagtaacggtgatagccccattcctctgcccggcgcgccaagtccatgctgtttcggaatgattctgcaatcgttcctccctgaacaaccggagataaattcaagacagaaagcaaggtatctttgcgttggttgttagacatattgttctcctttgcaaatgtgttatcagtaaacagcccaaagctgtcaagtcatgattgaaagaacttctatcacaccataacacaactgcattcaggaataaaagaatttgattcgatgaaattcgaacaatgtaaaacgaacggtttggcccgctattctgctccaaacagctccttagccatctcaataaagagcttagccgccagagaagcctcctttagcgacggaacagcaagctgcacatcacggtatacctgcgggtccaattcccgggtcaccacatgctccggaagcggcatccccgacatggacatttctgataaaatggccaggcccagtccttctctgatcatactgatcgaggtgttgatgttatagaccgtgaaagctgggtgcagcgtagcgcccgcctgcctgaacatatcgacaaatggtgattcatagcctccgtcacagacgatcatcggttcatggtcaagatctttcagcgtaatggccgaatgactggcaagcgggtgatcgtccctgagcacgacagccattttgtcttttttcaaatgaatgtactccatctcctctgttggatacagaagaatcccaacatctatcatccgcgtatgaagccactccttgacttcatttacagttccctcgtgcagcacgagcacaagtttcggatatttttgtttaaattcactgatcagctttggcataaaataagccgaggcagttgagaatgtgccgatatgaatcgttcccagttcaagccctttttccgctgctgctacctgctcaactttttcaatgccttttaagacttctctaatgtgtactaagatctgttttcccgtatccgtcagcatcaggccattgcggcggtcacgaatgatcagctttacatcaagctcagcttcgatcgcagaaatcgcatggctgacagccggctgtgtcatgttcagcgcctgacccgcttttgtaaagcttcccgtttcagctattttcacaaaaacctttaattgtgtaatggtcataacaatttacttatgctccttataaaaaagattcattttatttatcttatgttctaccgtatcatatgatggaaaagttctacaaggagtgaatgaacaatgaagcagctctcaaaaacgcggacagctctcctgctcgcatttctcgtcatcatgtggggcgtcaattggccgctgtccaaagccgcgctcgcctattctccgccattattgttcgcgggcatccgaacgctgatcggcgggcttttattagtcattgtcgcactgccgcgtattcataaattacgcttaaaagaaacgtggccgatttatcttgtttctgctcttttaaatattacgttattctacggcctgcaaacgatcgggctgaattatcttccggccggcctgttttctacaatcgtcttcttccagcctgttctgatgggtgtattttcttggctgtggctcggcgaatccatgtttgtaatgaaagtgatcggcctcatcctcggttttgcgggagtagccgtcattagtgctgcgggctttggcgggcatatttctgtcattggggttctgctggctctcggctccgcagtcagctgggcgctcgggacggtatatatgaaaaaaacaggcagccgcgtcgattccatctggatggtcgctctgcagctgacgatcggaagcgtgtttctgcttatatccggcttttggacagaaagcttttcggcgatccaatggacagctccgtttatcacgagcctgctgttcatctccgtattcgttatcgcgctcggctggcttgtcttttttacgcttgtcggttcaggagaagcaagcaaggtcgcatcttatacttttttgattccgctcatatcaatcgtggccagctccattttcctgcatgaaccgctcacccttagcctcttggcagggctgctgctgattgtcacgagcatctgtctcgtgaatacaaaatcaaaagcgcagaaagctgcggcgattggtataaacgagaaagctgcacaataataaaaaccctcttgccggatgcggcaagagggtttcttatttactgatgcttgcgtcctttgaccaaatatgcaactgtaatcaaaaggtagatcgccgcagtaatgccggtaatgacaattgatgttgtcatgatgaccccgatcagaatggcgagtaatgccacaatcgcaaaccatgtcgtgtacgggaaccattttacataataggccggtgtttccgtttgctgttttctcgattttaaatgagcgaatccgatgatcagccaaatgaataaaacggtatatcccaatgatcccattaaataattaaatgtttggcttcctgcgaacagagaaatcaatacgccaatatagagagaagaagtgcacatcagaatcgcaaacatcggtacgtttttcgatgaaagcttcgagaagacctttggaagccttccgtcacttgcctgtgtatacaaaatgcgtgatgatccgtataaacctgaattcatagaagaaatgatcgccagcaggatgactgcattcatgatatgatccgcgcccggaatgcctaccattttaaagaccatcacgaaaggactttccggaaccgaattgacttggttccatggaatcaggctgacgatgatgaaaaacggcagcaggtaaaacgcgacaatccgtgtcagtgtgctgcggacagctttcgggacaaccttttccggattttttgtctctgcaagcgttacaccgataatttctgtaccgccgtaagagtagatgacgacaagcatcgccgtgatcagccctgtgccgccgtgcgggaaaaatccgccgtggtctgtcaggttggaaaatccggatgctgtatgatcaccgaatgatacaaataagagcagcaatcccagaataataaagataataataacggtaatcttgatcattgccagccaatattcagtttcggcgaagattttaacagaaagcaagtttacaatcgtgacgataagagaaattcctaatgccaacacccagatcgggcagcccggcagccaatattgaatgaaaatcgcagctacaacagcttcagccgcaatgttaagcacccacattttccagtagatccagtccaaaaagtaagcagcgtaatttcccaatacctgctggacaagatcacggaaggttctggcgttacggtttcgaacagccatttccgccagcccctgcataataaacagcaaaataatcccgccgagcaggtatgcgataatgacagatggccctgccacatcgatcgctgagctgctccccttaaataaacctgcgccgattgctccgcccagcgccatcatcataatatggcgggacgtcatcgtgcgttttaacgtttgattgtcgtttttcatcctcttctacctctccttctcgttttcaaaaacaaaaaagcccgccatctcctacctaatctaatagataaagagacgacgagccttcggctgaccgcggtaccactcttgttgattcttcatgaagaatcctgcttttgacctgtaacgaaggttagccgttaaaacatagggaatattcaatctattccgttccgtcttaccactcccgggcgagttcaaagaagaatcaggctgcgtcgcaccaccccgcagctctctgttctgatcactttcttttactgctcccaatctatgtgttttagttttctgaaaaactcaaattttatgatctgaatatattaacataatatacgtgcttctcttttaactgtcaataacttcagagaaaaaagaaactgttattttgtcccttttcgaatggctttccaaaaggattctgactcgtttcctaatgcgtaaactgaaacacctgctattttatattgctttgccagatggcttttcgtttgaacggttttttcgttttcataccacacgacatgtttatgcttctttttgtcaacataagaaaacgtcatcgagcctgattttttgttgaatgccggctttgctttttgttttttgatgagggatttgagctcattccattcccttattgtgctggtacttccgtcttttacatcccagtcatagccgtacgcagggattcccatgatgactttattggctttgatctttttgactgaaaactgcagagagcttttgatccagtttgtgcttgccactgaccccggctcaccccaaatgccgtgttcatcgtaggtcatgacttgtacgaagtcggcatatttgccgattttcgcataatcatacggccagctccagtcatcatttttatcatcggcgcttttggccggaacggataccattgttttaatatgtttcttattcaaagcctgtgagacatattgaatgaagttcgagtatgcagcgcggtcttctggatttactgcttcaaaatcgatattgattccgtaatatgagtgctttttggccagtgtaattaactgatctgtgaatcgttttttcgctgttttattgctcatgacccgactcgctaaatctccgtcaaaatcataaatggcatcattatagtttgaaatgacagcccatgtcttgatttttttctttttcgcatatgtcagctgcttagttggggcatcgccaatgatttgtccgtttttttcaaacgcaaatgtatcggttgcgatggcattcatgtatgtatgatatttcgtaagagaattgtatgaagccgtatccccagtcgtgtagcctactgtcataccggctgccttcgcttctccttttgtatacataaacagaacaatcgcaatcgccagtgaaaccgctatgatcagccattttttcatcgcatttcctcctgtatcaagtcatactcttctcatcggccaaaaaattggaagttgaagttttttcaagcaaaaagcccggcatatgcctgccgggcttcctgagttcagcggtcagagacgagaatatatgctgcctttactggtccatgcacccccacaactaaatccatttcaatgtcggctgagttactcggtccggtaatgtagttgatacatgaaggaacagtgacaccgttcgcaatgttttggcggatgatatcactggcttgtgtcattctcggtacaatgcttgatttcggcacgatcgcaatataagtcgttggcaaaaggctgacagagcggccgatgtcttttgaggagaagaggacaaccgtccccgactcagccaatgtaatttcgctgaatgtaatccctacattggcttgctccgcttttttgatattttcctcgcctttgtcagcatcccactcccagaccggcgttccttcactcggccagtccttggtgagcaggcttttcagtccgtattcttcaaagcgggggtccttcggaatgatgacagggcctccagaaaagcggctgacttgctcgcgcagggcatcgtaaaggccggttgaatccgtttcaatcagctctgtatggattttgacacaatggtttttgagcactgtgactaagtcatccgctgaataaccttcaagtgttttatattgcggctgatgcgcccattcagggactgccacgcctcctgttcttcgttcacggcccaggctggatgcgattcggtttaaaaagctctcttgattctgaatagttcccttcgtcatcactgctcctccttcgtgcgttcacttgtttctctgtccgcaaaccagtctctgaatctcgatttatgcggtgccgggaagtcgcgaatctgggtccaatttttaagcgggccgggccctttcgaaattttttcgtcctctgtaaaaggcgtcatggcggccggcgcccattttgagcccattttgtaaagcgataaggaggatgcgccaagtccgaatgctttcattgcaagcttttcactgatcggcgccctgccttctttttcgacgatattctgacgatgcttgagtagcagctcatgaagcgggattttgaccgggcaggcttctgaacaagcagcgcacagtgaagatgcgtacggcagctccttataatcgtcataaccgccgagcaacggtgataaaacagctccgatcggccccgagtagattgagccgtatgaatgtccgccgacatggcggtacacaggacagacattgatacaggcggcacagcggatacattgcagcacagactggaattccgttccaaggatattggatcgtccattatcaacgatgacaagatggaattcttccggaccgtccacttcaccttccagcttcggacccgtcaaagctgtaatatagcttgtcagccgctgtccgacagcacttctagtcagcatgctgactagcacttcaaattcagaaaatgacgggacaatccgctccattcccatgacggtaatttgtgttttcggcaaggtgctcacaagccgtccatttccttcattggtcacaaggctgacggaacccgtgtcagcgatggcgaagttacagccggtaatgccgatatccgcttccagaaactttttccggagaatggcgcgcgcatgcatcaccagctcttccggtttttctgtatgttgatagtccagtctttctttaaacacatcgcgtatctgctctttatttttatgaagggcgggcgctacgatatgtgacggcggatcgtgatcatcaatctgcaaaatatactcgccgagatcggtttctacgacttcacagccttccttctccagcacctcattcagattgatttcctctgtgaccattgatttagatttcacaattttcttcccgttcttcttttgaatgacatcccgaatataggaagacgcctcttccgctgtttccgcgaaatagacatgtccgcctcttttcgccacattttcggcaagctgtccgagatagaaatcaaggttttcaaggacatgctgcctgatttcctctgataatgagcgccactcctcccagtttcccagttcttctgctgcctctaggcgccgcgtccgcagacgctcctgtgcacctgaaacagcgcctctcataaattcattatcaatcccctgtgatacccgctctttaaaagcgtcagtaccgattttcatcgccatgatcctttccccctctgaatccagttttatctgctgttgagcacttcggcgatgtgcatcactttgacattcttatcttttcggccaagccgtcccccgatattcatcaaacagccgcagtcagcaccgatcagcacctctgctcccgtttcctccacacattcgactttttcatcgaccatctgctcagaaatctgcgccatcttgactgagaacgttcctccgaatccgcagcagttatgtttgcccggaagctctgtaaactgcaggcccttcacatggctcaacagcttcatcggctccttccgaacacccagcagcctagtcatatggcacgacgtatgtaaggtcgcttttgtatgaagggtcgcgccgacatcctctactccaaggacgttcacaataaaatctgtcagttcatacgttttatccgccagctttttcgctttatcggcccatttcggatcatcctgaaacaggtgcggatactcccggaacatcgttgtgcaggaacccgaaggactgacaacatattcggaatcctgaaacgtttcgatcatccgtttcattgcttttttggcgtcatgtacatagccgctgttgtaagccggctgtccgcagcaaatctgcccttctggaaaatcaacctcgcacccaagccgctccagcagctcaaccgttgcttttccgacatttgtttgaaacatatcaacaagacaagtgacaaaaagtgagactttcatgatgaacccctctctcatccccaatatatgatcaggtcatctgatgacctgagttaaaataactatatgaatatcgtacactattctgacaatggaaggaaagagttttctagggatattttcatttgtggcatatcaaaaacactcccgatctcccaggagtgcagtatatggttagatccagcccttttcctcagcgatgctggcggcttctgtccgatttttcgcattaagcttttggatgatttctgagatatagtttcgaactgtgccttgagataaatagagctccagcgtaatgtcttttgttgtcttgcctaaagccgcaagcctcagaatttcttgctctctaacggttagcggattttcgtctcgcatcatattaaacgtcagctcagggctgaagacacgttttccctttacacattttcgaatggcatcggccagatcgtcaatttcgccgtctttcagcagatagccatgtgcaccggcctttacggcacgttcaaaatatccggggcgggcaaaggtggttaaaataatgaccttgctgacgcagccttttttcattaattcctctgccacattcagcccgcttcgaaccggcatttcaatgtccataatgcatacatccggctccagcttcaaaatagcatgtagcgcctcttccccgtttaatgcttgtccgatgactgtcatatcctcttctaaatcaagcaaagatcccaaagcgcctaaaagcattcgctggtcctcagcaataaacagacgaatcattcttttcgtcctccaatcattctgcttttttaataagcggaatcgtcagtgccacaaccgttccgttatggtctgaaaccgttaatcccccttcaatgagcatgagccgttcttccattccccacaggccattcccaaacattttctccttcggcgctccctttccgtcatcccgtattacgatcctcattttgtcagcaaattgagaaatggtgatggcacagtgggttgctttgctgtgcttgataatgttagtcacggcttcccgcatacacatactgataatattttgagtgacgggagatatcgctgaaaagtcgtcggctccttcgtattgaaaggtaatgttccccgctcttaatatgtgctgaatgtttacgagctcctctgttatcgtgaccgtcctcatatcagaaaccagctctcgaacttgcttgagtgcggatcgtgagctggtttccatttcttttgcctcaagcttggtccgttctggatcagatgcagccagccgctgaatgagctggctttttaatgtaagcagcgacagggtgtggccaagagtatcgtgaagatcacgggcgattcgaacacgctcctctcttttagagagttcttttatctgttcgttggcttgtgcaagcttattttcaagctcaattctccgaaacatagaacgaatgccgaatggagaaatgagcataatgacgagaaacgggagaacagaaaaaagctcccggagcgagaccgaattcgcgataaattggtataggcatggaaaaagcagtataaagattaaagcgcagaacgcacggttaaaattcgttttctctttgaaatagccaacaaagtttgccgggaaaaaacctaagtatatataggtgatattgtaaaacacactatacatcaaaataaccgccatttgcacgataagccaatatgtaaacgaagctttgcccacgctgcagaataactggcgatatgccgctacaaaaaggagcagcatgccatatccgatcccctgtttgacacctgattcttttaataaagagaggaacggcataatcgtatacaccagaaagatataagggaaaaacccgaattccttcgggaaaatagatattgcctttttcatgtattacaccgcttcttgttttcttcttatatatttagatagtagcatgaagagcatcatataagcgattaatatcagaatatttttccaagtcggactcccaccccggacaagttcccacgctccgctcccgaaatgataagacggaagccactggccaatgctctgcatcatgtcaggcatgacctcaaacggcatccacatccctccgcctaaagccagcagcatataaagcacattactgattccggccgctgtttctacttttctcatgaggccgattagtgtgcctaatgctaaaaaaggcaatgcgccaaacaaaatccacagtccgctcatcatccattcaaacggtgacaaggcaatatcattgatgattgcgccgaacagaaatatgacggtaattgataaaacgtgaatgacactttggccgatcatctgagctgataaatagatatgatccggaagaggcgtaaggcggataaaggcggcccagccttgtgaccgttcttgtaccattcggatgccaagcgtcatgatagaggaacccatcacgctgaagactgtcatcgacatcaggtaatgggcttcccatgcacgttgatcagggacgttggtattcactacatttgtaaagaaataataaaaggcaatcggcatgatcagagaccaaagcacaaagtacttgttcctaagcacccttttcatttcagcgatgctttgcttttgcagcacgttcactcacatcgcctccctgttgccgtcagccagctggcgaaatgcctcatcgagcgttgcttgctcaattcgaatatcccgtgcatgtatgttttcttgaaagatcagcgccaacactttgtctgtatttgatgtctggatgatggttctctcatgctcgtggatcactctctcgacttccgggtgacaagacagcctttccaatgattcacttgaatgaagcgtaaaggaaacagactgtttttgaattcttgagcggatttgcattggtgagccgtctgcaacaagctgtccttcagtaaaaaataggattcgctgtgcggcatcatctgcttcctgtaaataatgagttgaaaaaataatcgtttttccttggtccgacagtccgtgaatggtctgccagaatcggtgtcttgatgaagtgtccatgccgactgtcggttcatcaagtataagcagctccgggttcccggcaagagccaaagcaaagctcaaacggcgtttttgtccgccggataatttttctgctcttgttttcaaatcttctttggtgagtgctgttaacgaaacgagttctttcatggacaatggattcggataatagctccggaagagttcaaggatttcatccaccttaaggcccggcatgacacttacttcctgaagcattacacctattttttcacgaacctgttgatcatcgggaacccggttaaatagtttgatttctccctcactcggtttcagcaatcctaatatcatcgagacgacggtcgtcttccctgccccatttggcccgagaatggctgcaatttctcctttttcaatactgaagctgatgtggtttacagcggtttttcgctggaaatgttttgtcacgttgcttactgttactgcttctttcatcacatgagcacctcctgatcgtttacattgattgtaaaatgacggagaagacgatgttagtatggggtgtcatgatgatgaagtgacaaatgtcattttctttctcaccccggtgtctaggtaatcctcctcctgcatcttccaattcatccatcttttctatctcccatgtcctctttcttttaaactgctgtgacattcatagaaagatacactcttcaaaccatccgagtgttatgatagacatattgaactttatattactttccggctgaaaggagccaaacatgaacgaagcgattttgtctagaaatcatgtgaaggtgaaaggcagcggcaaagcatctatcatgttcgcacctggttttggatgcgatcaaagtgtgtggaatgccgtggcacctgcctttgaagaagatcatcgggtgattttatttgattacgtcggttcgggacattcagatttgcgcgcatatgacatgaatcgttaccagacacttgacggctatgcccaggatgttcttgatgtttgtgaagctttagatctgaaggaaaccgtgtttgtggggcactccgtcggggccttgattgggatgcttgcatccatccgccgcccggagcttttttcccatctggtgatggtggggccttctccttgctatttgaatgatccgcctgagtattacggaggatttgaagaggagcagctccttggcttgctggagatgatggagaaaaattatatcggctgggcaactgtatttgcggcaaccgttctgaatcagccagatcggcctgaagttaaggaagagcttgaaagccgtttttgttctactgatcctgtcattgcccgccaattcgcgaaagcggcgtttttttctgatcaccgagaggatctttcgaaggtaacggttccctctcttattctccaatgtgcagatgatatcatcgcacctgcaacagtaggtaagtatatgcatcagcatctgccttatagcagtctgaaacaaatggaggctcgcggacattgccctcatatgagccatccagatgagacgatacagctgatcggcgattatttaaaggcacacgtgtgatataggaacgaaagggatagaggtgaccctcttagatggacaaacaattgaatgatgcaccatgcggtttcctcgctttgtcagaagaggggtcgatcatagctgccaaccgcacccttatcaagattctggattatgaaccggagcaggttatcggccagcacatgaatatgatgttgaccattcccgcacagcttttctgccagctttatttttttccgcttttgaaattggagcatcacatcgaagaaatatacatttccttgaaagcaagagatggagaagaaattcccgtccttatcaatgctattgcgagacacgatagcgaggcttctgtctttgattgtgttctgattccaatgcgaaagcgaaatgaatatgaaaatgagctgctgatagccagaaatgaggctcaggaagctttgcttgccaaacagaaagccaatgcggagttaaaaattgccttggaaacgcttaaagcaaaacaagaagaacttcttgagatcaataaacaaaatcaacaatttaaattaaacaccaaaagagagcttgaactcgccagaaagatccagaaaaactcgttgactgaaccgattgtaaacgatcaggttcagattgactcttattacaacgcatcgagtgaattgtcaggtgatctttacggatattatcaaatcgatgaacaccgttacggcattattatccttgatgtgatggggcacggaatttcatctgcattgattacgatgtctcttcatcctttgttccagcgccagatcacgcaaggtctcagccccgttaaagttatgaaggaattggaccggcaccttcacagcttgtttcaaaatgatgaggaagcaagacattattgcactgctatttatctcgagattgatatagcacggcaaagaattgattatgtcaacgcagggcatccgccggcactttggcaggacgatagcggaactcaacatctgcttcacgcgacctcgcctccgatcgggatgtttgaagacttagagtttcagtcaagcagcctttcatacacggaggacggaagattgcttctgtatacggatggcgtgatggatcctacggcttcatgttatttatatgatttactaaaggatcaacctgattcgccgatcgctgacctgaaggagaacatccttacatcactgcagcatcaaaaggaagctcatcataagagtgatgacgaatgttttatattagttgatgtaaaataaaatgatccatgagacataacaatgatttgttacatctcatggatttttttgtttcagcgtttctttggaatatgtcctgactccgcatattgaaacacctgcaaagaaggcagcgggtgtccattaaaatcaaataaagcttgattatctacagcacttcccccataccacttcccggcgtcttcagggtcgtattcagcagcatagctggacgcccaccctgacccgtatgtttcccataacactttgtttttctctatctgtgtcttcggcccgactggaatccacgccggctcccagtagaaaacaccgagtcctgctttgcccgtattcgccactgcctccattacatctcttactgcagttgcctggccttgaacagaaattggatatggcagcgtctgcccgctttttggcgctgtatttccatgcccatcgccatcctcagcggtataggtgtacgatgtttccgccaccatgacttttttgccgtacgtattggcaacagccttcagcacggaggtcaaattttgtaatgtcccatgccagaaaggataataggagctcgcaaacacatcataatccactttgtttttgctgagtgtttccgcaataaatgaataccttccagccgtttcaggattggtaaaatgcagggcgaccaaaatatttgaatttgtctccctgaccgctcggcttccttcattaaataattggcacatcttcgtccaatcagtctcaccggcaaatcctcctgttgtttcatttccgacctgaaccatgccgatgtcaacgccttccttgatcatcttttgcaggctttgtttcgtatactcatagagctttgctttttttgcttcaaagctgagattcgcccaggctttgggcaccttttgtttcgctggatcggcccagaaatcagagtagtgaaagtcggccagcaccttcattccgttcgctgtcgctctttttccgatttcgattgctttttgaacatcattgtttcccccgccatacccgttgccatttgaatcatacgggttattccagatgcggacgcgaacatagttgaccccagcctgttttaaggttgtaaagatgtcctgacgttttccgcttgtattataaaaggtgacaccgctgttttccaaagcaataacgctggacacatctgcccctttgataaaatccttgttcatcccctctacttttttaacaaaaagatcctctgtccgaagctctgacacgtgcttgtccttctcaatggcagcggcatatcctgttgaactacatgcactccacacgatggcagccgcaaagaacattttcactttgcttttcatgatttcatcccccaaagacttagcaagcgttttcattctatagaaaaaagaatccgcccatatcgagcggagcatcagcctaatgtgtgtttacgacaattctcacttcatacttttccatcgtcaggtcgcctgacaatatgtctcctgtcattatgtccttcacactctgatcaaacgtgaccagttgtttttcttccgtaaagttcatcacaaaaatataatcattgtcctgatcctgcctcgcttgtacggagacgccttttccgtgccgaaccggaaaaactggagaaagagacaggtctgtgatcagaccctcatagaaatcacgctgaaattgatcctccaaacgcgcgccgataaaatacgccttgccctgctgatactcatggcttgtgaccgctggcgtgcgcgcataaaaatcttcttgatacaccgcttccactgaagctgtctttacatcaatcacggttgcataatccttcatttcatatatttggctgcggtagctgacagcgtttcgatccttcggatacagggtgtccgtttcaagaggctcaactccaaatatagcttgaagatccggatgccatccgcctgtgtatgttaagtcatgctcattcacaaccccgctgatatacgtcatgactaaggtgccgccgtcagccgtaaacgcttttaaacgggaaatggtgtcctcgctgattaaatacagcatcggaacgatcagcagtttatatggtgaaaagtcttgttctttcgtgatgacgtcgacagggatatcgtgttcccagaatgtgcggtaatgctgctgaagcgtttgcggataacgttttgtcgccttcgcaaacccctgagcatcctcgagcgcccaatgattttcccagtcatataaaatcgcggtttgagccggcctcttcgttccgacaacttcggacagccgttccaatgtctcgcctaccttggccacttcttgaaagacgcggttcctcgggctattgtcatgatccacaaccgccccatgcaatttttctgatgacccgcgtgatttgcggtattggaaatagagaacgctgtccgagccgtgggcaatcatttgcatggatgacagcagattcatgcccgggcgctttgccttgttgacgttatgccaattgaccgcgcttggcgtacactccattaataagaaaggctgctgcttcaagcttcggtacaggtcgttgataaagccgaccttcatcgccaaatcagctgtgctttcccagtcattgtgccagacaggataagcgtcccagctgatgacatcgacatgctttgcaaatttgctgtagtcgaggccctgatacggaatcaaatccgctgtatcagccataaagttcgttgtgatagggatatcaggcgtcaattctttcagcggaatgatttcatttttataaaacgaaatcgtttgatcggtgacgaaccggcgccaatctaaattcaggccatgcaagccattttcaccgatcggcgaagggctttcaatttgtgaccagtcattgaacgtatggctccaaaaaggagtccaccacgcatggttcaatgccttgaggctgttgtcatatttcgatttcagccactcccggaaagcatgctggcataaatcacagtggcaatctcccccgtattcgtttgaaatgtgccacattaacagcgccgggtgatgcccgtatcgttctgctaataagcggttgatgtgccgtgttttttctcggtagactttagatgtgaggcagtggttgtgccttccgccgtgcagctgtttgacgcgggaggcattgacgcgcaaaacttccggataggtttgcgacagccaggccggacgggctccgctcggcgttgctaatatgacccggccgcctatactgtgaatccgctcaaaaatatcatccagccattcaaattgatatacgccctcctccggctcaagtgcgctccatgcaaaaatgccgacagaaaacgtattcgtatgagaaagcttcatcagtttgatatcgtcagctaaaatatcgggccgatccagccactgatcggggttgtagtctcccccatggagcataaatttcgcttctgttacgtgcgttttttcaagctttgacatcacattctcctccttgttctcttagcccttcgttccgcctgcggttaatccggatacaaaattcttttgcagcatgataaagatgatggccaccggtatgctgataagcagggctccggccgcaaatgtcgtatagctggcccccatgacatcattcactaaattgaatagaccgacgggcaatgtatatgattcaggcgttctcaatatggttgaggacagcacaaaatctccgagcggaccggtaaagccgttcatggccacgactgccgccatcggttttgataatggcagaatgatctggaagaagattctcgtgctgctggctccgtcaatcttggcgctttcgtctaaatccatcggaatggaatccatgtaccctttcatcaaatacgtattcatcgggatcaagccgccgatataaagcaagattagcagccaatggctattgatcattcccaagatttgcgccagcacaaacaaggcaattaaagctgaaaactgaggaatcatctgcagcaataaaaagagcgttaaagcgtatttcctgcctttgaagcgaaagcgcgaaaacgcataggctgtaaacgtcacacagagcaaagaccctgccattgtaaacaggctgatcttcattgagttgacataccactgcacatattgaaggctttctttgcccgcaaataattccttgtaatggtcgaatgtcggatgcttcggaatgatggatgtactgattaagctgttgccaggattaaagcttgcgcctgccgtccaaaggagaggataaacaatgatgaccgccataaaggctagcaacaagtaagagaaaaggagacggatatattttctgactttcatatctgccagcataccttatgccccctctttaaaagactttgtctgtctgaattgccacaatgcgatggagataacaaatacagataataaaatggttaaagccgcagcaagagaatattgactggactgcattgtcaatttataaatccatgaaacgaggatatctgtcccgccggctgttgatccggttacagccggacctccgccattgaatagatagataatattaaagttattaaaattaaacgtaaactgggtaatgataatcggagccattgcaatgaacaccattggaagcgtgatgtatctcaactttgaaaagacagaagcgccatcaatcgtagctgcttcatacagatcgtccgggatggattgcaatacgcctgttgagacgagaaagatgtacggaaatccaagccagccctgcatgagaatcaacgcaagcctcgaccaattggcatctgtcatccacggaagcggatctatcccgaagaaagccaagatatcgtgattcatcgcaccgaagctatcattaaacagtcccgcaaaaattaaaatcgtcacaaaaccgggaacggcccatggcaaaatcagaatggtccgaaaaaaacgtttaaaccgaaggtctttctggttaacaatgatcgcgagaaaaatccccaagctgacttgcagtgtggatgcagcaagtgtccaaaccaccgtccaagccagtacatcaaaaaaagtcgacctccaaatatcaactgtgaaaatatttgcgaacgtttgaaaaccgacccaatcaattaattttgcaggaggagaatgatacaaatcatagtttgtaaacgctaatgcaaagctgaataagataggaaagatcacggcgaaaattaaaataaacaaagatgggccgctgacgacataaggatagccctcagaaatgatatgttggtattgttcctttaaggaacttaatggcttattttcatcacgctgttttccgctttggaacgcatcgcgaagattcacataatacaccgcaaggccaaagcaggtcacgatgacagcaataattccttccgccagcagaaaaacggaattatcccgcggcacttctgttcccagtgtaaagattccccaaaaccccatattgagcagatctccaaagaccgcaaaaaacgatgcgcctaagaaaagaaagacaataccttttatccattgcttgttataaaattgcccgagtcccggaatgatagaaagcaacaaagcgacttgacgatgctgcaccgttttcacctctcttacaatacaaatctagctttctctttattttccgctgtgctttgccttaatttgtcctttggccgtttcagctgcttgatccaatgcttgtttcggatctgccttccctgttgcaaccgtctgtaatgctgaatcagccggcatccatatttcattcatttccggaatatttggtgttggctctgagaaacgggattgttcagtaactgcccgtgccgcctcgcttttcataatagccgggtcattggctagggatttcacagcaggaacttctttcgtctcttcatatcgtgttttagaatttttttcatttgccaggaaaacggctaattcttgcgccagctctgcattctttgaaaatgcactgacgttgtagcttttgacgccgataaaggagctcatgtttttcccattttccagcttcggcagtttcgtaatgccataattgattcctgctttcgaaaaggcttctacattccatggaccagaaataattgcggcggcttttccttctgtgaacagcgattccaatacgttaatcccttgttctccaataatgccagccgggaacaagccatctttgtaaaacttctgaatcagcgccgcacctttgacagctccttcattattgattccaatgtctgacgggttatagctcccatctttggcctttccaaaaatgtatccgccatatccgctcatcacactttctgcataataaatttgatcgaatagggctaaaaagccaaatttgctgccatcagcagtctttttggaatagtcgtaccactcttccagcgttttgggcaattccttttcggagatgagatctttgttgtaaaaaaggacagtcgtttcgaccgcttttggcagtccataaagcttttgatctaccatttgagactgaatggaagcgtcagtataaagtgattgaacgtcttttttgacatgtaattccttgagtaatccttccgtgacagcggttccgatttggtcccctggcattgttaacacgtcagggcctgtgccggccggtccgtccattcgcaaatcttcaatctgcttggcatacggtttttcaacgactttgaccttcacatcatgctctttttcaaatgcagccacagcgtctttaatgccgttgctcttttctttatcctcccatacaacaagctctgacccttttgaactcgatttagcgctgctgctttcctttgggccgcaagccgccaaggataaactgacagctgcgcagagcatgaatacggaacacctttttgcctttttcattgattgtcaccctttcggtaggaatgaaagcgctttaaagataatatagcacgcctgagaaaatgtgtaaacaaactatttacctcctagagtaaatttttttacctaaataaaaaatgacttagtgtcctaagtcatccttaattcatactcttcctgacgattaattctgcgcccacatataaggtttttaccgttcttctcttgtcctgcacttgttcaagcagtaattgaacagcatttttacataattcatgtatatcaatatgaaacgtcgtcagaggaggcgagacatacttcgcgaagctgatgttgttgatactcacaatgcttaccctgtttggtatggcaattcctttttcgttcagggcttgcagacagcccactgctatcgggtccgctgcaatcataaaagcagtcggaagctgatcgcctaatgtgtcgatcgctgctgacatcaggcggtagccgttttctacagagaatccgcgatgacaaaaaatatagcgctcgtccagcatggctttttccctcatataggatctgaaggtttgttcacggatgtccatttcatcctgattgttattcggatttttgtaagtgccgccgataaaaccgatgctcttatgccccttctcagtcaggatgtttaccgtcttccttgtcatttgtgccaaatcgggccttaccgagtcaaaatgatcgggatcaggagttgaatcgatgaacacgccgttttcagtgagatttctgaggaaagccagctcttcatctgaaaatgtgccgacggcaataaacccttccgtatgttctggaatgctctcgattccatccgctattttataagtggtcatatcgacattgaatgctttcgccagtttctctacttctaatctcatcgttttaaaatagacatcttctaattcttctttatctgtcagccaatataaaaacgcaatatgtttcaccagcggccttactgtttttttgcggtaattgagcttttccgccgcttcatagattttctcccgtgtttcatcaggaacagaaaggctttcatcgttatttaaaacgcgggaaacggttgagattgaaaatcccgcttcctgcgcgatatctttaattgtcgccattgcatctgcctccattattcagcttgcattgttttagtaaaatattttactttctttttcgcaaatgtcaagtgcacaaagccctctggctgcctcatgtaaaaaagactgaaccattcgcggctcagtctcagttgttcgtatcagtcggaaccgacggaattgcccgggaaatgagttggttattgcacattttcctcgaaatatcccgaaagcacatcttccacattcgtcaaatgcgccagcattgcggcttccgcctctgcaccgttcccggcagccacagcattgtaaatccgttcgtgctcctcatacagccgctgaacggaggtcttcttggaaaacagccagattttcctcgtttccctcattgtttccagcagcaatgatgacacgtgattcatcaagtgtttaagaagttcattttgagaagcgtccgcaagcgcaagatgaaatgcgaagtctgctttctctcccagctccccgtccgtttcaatgctgcccatttcctttagtgcatcctgaattctttcgagatctgcttctgtccttttttcagccgctagtgaagccactccgatttcaagcagttttctgacctcgagcagctgcttgacgtcctcttttttcatcagaagggcggctgagagcggctgagaaatttgattgagctcaaattccttcagatacgtgccttctccctgtttcatttcgacaagccccatcgcttttagcgcagaaagtgcttcgcgaaccgctgaacggctgacttgaaagctctcagcaagcgcctgaacagagtccagtttatcccccggcttcaattcgccatttttgatcatatctaatagggcatccgctacttcttcatatattttttttgttttaatctgtttatatttcaatgcaattcaccccgtaacttgtaggtctggctgtttacgatctattatactctgttgtgtgggccgccaaaagattttgactattttgtcaaaaagtcttgtactttgatttttttcaaaatataatgctaggtaactggtcttattacccagtcatcagatgatcatatcatctatagaaaccgcttacatatggcgccagtttatgtttcaaggaggggtttgggatgcaatggacacaggcatatacgcctatagggggaaatttgctattatcagcgcttgccgcacttgtaccgattattttctttttttgggcactcgcgattaaacggatgaaggggtatacagcaggcttggccacattggggatcgcccttatcattgctgtattggtttatcggatgccggcggaaaaagcgctgatgtccgcgacacaaggagccgtatacggattgttgccgatcggctggatcattgtgacgtctgtttttttgtataaaatcactgtgaaaacgggacagtttgatatcattcgcagctctgttctctcaattactgatgaccgacggcttcaagctctcttgatcgctttttcattcggggcttttttagaaggggcagcaggcttcggagcgccggtcgccatttctgccgcgctgctggtcggtctcggctttaatcctctttatgctgcggggatctgtttgatcgccaatacggcgccggttgcctttggggcgattgggattccaattacagccgtagaagggccgacagggattccggcgatggagatttcgcaaatggtcgggcggcagctgccgtttttatccgtatttattcctctttatttaatcatcatcatgagcgggttcaggaaagccttggagatctggccggcgattctcgtatctggtgtttcctttgccgttgttcaatatctcagttccaattttttagggcctgagctgcccgatgttttgtcagctcttgtttcaatggctgcgcttgctgtgtttttgaaatggtggaagccgaaaacaacattccggtttgccggtgaacaagagtcggccgcctcaattgaaacggcgcgcacaaatccggcagcgcctgcgtacagcggcggacagatttttaaggcttggtcgccatttctgctgctgacggcgatgatatccgtatggggcattccatctgtcaaatccgcgctgaccgggcattatgaaggctctgcggtgttcttaaagtggctgaatgctgttggagaaaaactgactttttccccaggtgtgccttttttgaacaatcagattgtcaatgctgacggtacaccgattgaagcggtttacaagttggaggtgcttggttcggccggcaccgcgattttgattgccgcagtgctgtcaaagttcatcacggcgatttcatggaaagactggggaaccgtttttaaagaaacagtccaagaattgaagcttccgattttgaccattgcttctgtcgttggttttgcctatgtcaccaactcctcgggaatgagcacgacactcgggatgacactcgcgctgacaggttcgatgtttaccttctttgcgcccgttctcggctggctcggcgtcttcattaccggctcggatacttccgccaacctgctgttcggcaacctgcagaaagtcaccgcattatcagtcggcatggaccccgttctgtctgtggccgccaactcttcaggcggtgtcacaggaaaaatgatttcaccgcagtcgatagcggtggcgtgcgccgcggtaggactcgccggaaaggagtcagatcttttccgctttaccattaaacacagtctgtttttgctgctgctcgtttgtatcatcacctttttgcagcatcacgtattcagctggatgattccttaaaaaaatcctcccgtctagggaggattttatttatatcgctttctcgctgccgatgacggaatattcatttgatcgcgatattttgccacggtgcgtctcgagatttggatgccgtgttgttcatacagcaaatcgacaagcttttgatctgaaagcggttttgttttgtcctcttgattgatcaggtcttcaagatgcattttgactgcataattcgacgcatctccctctcctgaagcctcggcttttgctgagaaaaagagcttcatctcaaacagcccgtaaggcgtttgtattgttttccctttaatggcccggctcacagttgattcatgaaggcttagacagtccgccacctctctgagagtcagcggcttcattgcgcttcgccctttcagaaagaaatccttttggcgtgtgatcagttcattgataattctcgtgattgtctgttttcgctgcctcagcgcgcggctcagccagcgccactcctgatatttcgcagataaataggagacagtatcctgacaggagccggatgataaaagcgttctgtactgcggatgcagatcgatctcgggaaacgagcgggtattcagttccgctgcgatgtgcccgttttttacagtgataaaaatgtcaggctcaatatacacatcttgctctggccgggcaaacagaaggccaggtctaggatgaagagccgcgatatcatctgagatatcttgaatagtatgaagcggaattcctgcctccactgaaagcgctttccattttttttgcgcaaaagcatcaaaatgagctgaaaccagcatttccgcttgttcatttctgttcggcagccgctgtaattgaagaaggatgcattcctgcaaagatctcgcgccaattccagccggttctaatgactggagttttgccaaaacagcctccgcttccttggccgatacagataatcgccgtgctgcctcctctatatcttcttccaagtacccgtttgaatcaagcgaatgaatcagataattaaaaatctttttttcagtgtttgtcagattcatatcgagtgactgctgttttaacgcatcctgcaatgttttttgcggattacttaattgaaggcccgcttcctgtgcattcatcctgtttttgtttgttttatggtaagatagtggcggtgtgtctgtttcctttcgttcaataagagggttttccagtgagagctcatcaatgtactcggcgagttctgccgaatgatagccaagcagcgtgatggcctgcctgagctcctgtgtcagttgaggctttaatacttgtacttgctgaagtttcatatccatcttgctcactcccctttcttcattgtacatgattgagatcacaccgtatacatttatgaaaaaggagctgccaaagaaatgtctgaacttttttccgtcccttattttattgagaatttaaaacagcatattgaaatgaatcagtctgaggataaaatccacgcgatgaacagctactaccgttccgtcgtctcaacactagtgcaggaccagctgacgaaaaacgcagttgtcctgaaacggattcagcatttagatgaagcatacaacaaagtcaaacgtggagaatcaaaataaaccttccgctcacatgtgagcaggaaggttttccttctttgaggcgtgctggatgagccgggtgctcggcactccttccatccaggtatgaaagtaattggcgtttttcccataggaattatcaatgaccgtgttttctttttgaagaagagaagacaagatgtggccgtgcagccttgatgtttccaccgattcgtaacggctgaaaaaccgaatggctttttggacgatataatccgagtatttttcccatatatacgcaatgggcaaagggttgcctgcttttttattcaggacgttcagcgtttggagaaaagcaatcgtccggcggtctgaagctgacagcaccgtgcgccagtcgtagctttccgcttctgcgtgttcctgaagcgcctggtttgcttcatgatctgttcggataaatctcagcttttgattggacggctgctgcgtgggaatgacgggaaacagctgatgagccatatcaggcagaagctgaatgtgatttcttgaaaaataagcctgcgccgtagcataggaggctttttcccttgtcataatgtgaaggttcgcatgcttagaaaatatctctgccgtccgtttgaggttgtctttgttttgaaaataaatcgattgcggcaggatcacaattttgtggttcggataggtttggacgattttctctctaaagccttgataatacggatacagatccccgaagtttccgcctccctggcagacgatgatgagatgaggatccagctttcgcccgactggaaaattgtcaggattccagcgttttctgacccgaatcccgtgttctttaaagaaggcttctgttcctttcataataaataaatcccctacattcccatatagaggatagtcagcatatataatctctgattgtttcggtatgacgtcgagcagcccggacagtttctgtttcaggctgatcatcgaatgcttgctgtccatttcttcacctcggcagtttggaataagtgcagtagcacttcaatgacccggtcttgctcatcttctgtcatattggaccccgatgggagacagattcctcgcttgaacaaatcttcgcatacgcttcctgtatcttcatgagaataaaataaagccggatcgaatagcggctgggtatggagcggcttccacagcggacgggcttcaatgttttcttcagcaagacgttgaactatgtcatatgggctgagcccgttatcaagtgtgagcgtggtgagccagcgattggatacgcctgctgcgtactccggcataaagcggacgccgtctatgtgaccgagcgcatttttgtatctcgtgaaaatggtccttcttgtctccactcgctcatccagcacctcaagctgggcaatgccgacgccggctaagatattgctcagcctgtaattatgtccaatttgactgtgctgataatgaacagccggctctcgtgcctgcgaagcgagaaatcttgctttttcaattgcggcttcatcatttgaaacgagcatccctccccctgatgtggtaatgattttgttcccgttaaatgaaaaaatgccgaagcgcccgaatgttccgctttgcttccctttatagactgttccgagagattcggctgcgtcctcaatgacaggaactccgtatgcatcgcacagacttacgatttcatccattttcgcgctctgcccatatagattgacggcaatcaccgcttttggcagtgttccatttcttttcgcttcctccaatgctctttcaagggctgtcggcgacatattccacgtatcaggctcagaatcaataaagacgggcaccgctttttcatatagaatcggattggcggttgctacaaatgtgaaggactggcaaaacacgctgtcaccttcttttacctcaagtaaacgcagcgcgagatgaatcgccgccgttcctgagctgaccgcagcagctgcttttacaccgactcgttctgccagctgttcttcaaatgaattcacgagcggcccaagcggcgcaatccagtttgagcgaaaggcttccgaaatatagtgctgctccctgccgctcatatgagggggagataagtagatttttttatgcatagaatcatcctttgtttgatgtttgaatggaagaaatgatgcgtgccggagcaccggccgccgttaccctgtccggtatgggacggatcaccgcggagccggctccgacaatgctccaagccccgattatgatctgcggtatgacggatgcaccagttccgacgtgagcgccttcctgaacggaaaccgctcctgacagcgtgacacgcggggacagatgaacgtaatcgctgatttgattgtcgtgctctgccactacacccgtattgatgatgcaatgagcgccgatgcgcgcatccgcctgaatgatcgcgcccgccataatcactgtcccttccccgatgacagccgacctgctgacgatggctgacgggtgaatcaatgtaataaaatcatctttccccagtcccagtcgctccgccagctgttttctgacactgttattcccaacagcaatcagaaacagcacatcaggaatgagcctgcgcagttcagtaacggcttccggcggtcctgtgtaccattcttttccgtcttcgaacgttttgaatttatcatccagcaccgcggctaagcgcgtatctgagcgggcgtttatcagctctctgatcacctttccgtgaccgccgtcacccacaatggccacatttttcatgaggacacatctccgcttccggtaaaccgttccgcggtcacatgattggtttgctgaatcccttctgaaacaaggacctttcgcaccgtcaaacataaaattttcaaatcgagaaaaaatgaccagttgtcaacgtaccaaacatctaattcaaatttcttttcccaggaaatcgcgtttctgccattgatttgcgcccagcctgtgatacccggcttcacctcatggcgccgtgcctgtttttctgtataaagaggcagatagtccatcaaaagcggccgcggcccgacaaggctaagatcgcccttcaggacattcaggagctgcggaagctcatcaatgctcagctttctgatcagcctgcccgttttcgtcagccggacttcatcgggcagcagatttccctcactgtcccgttcatccgtcattgtccggaacttatatagggtgaacggtttgccgtgcaggcctggccttacttgcttaaagaagacaggtgatcctattttcagcctgacaacggcgatggtgaacagaatgatcacacttgtacagcacaacaaaaaaatggcggccgtcagatcaaaaagtcgtttcaggatcaaagattcacagctcctttcgtttttcgaaaccgttttagtatcagctgtctttcctcttttgtacaaacgagcataaaagcgaaaacagcgtagcaaaagctgactgtcactcccgtcgctatcagtgacggccagccgtcaatcttcacaacgaactgaatcgccttacagaccgtccaggcaaatacagcggctgaaagaggcccgatgatgcctttaaagaacacgtgctttttgtagcctgtaatgcgggatacataaagcggcgtaaatatggcattttttaaaataagagaaatggcccctgccaacgttatgccgtacagaccgagatgagccggcccgctcagcgtgaccgccagcaccacattcaccgcacctaacagcagggtaacaatcgccggtgttttttgttgattaaaagcggtccatatataaaacagcggcataaaggcgaggctgacaaccaagtatccggcatgaataaataaaagcggtgctatcgttgaaaaggagggtccgagccagattgtcaaaaaaggtcccgccaatccgcccaataaggcagcaggaagtgcaagcaaaagaccattgagccttactgccttattggcgtaattcatcaatccttccatatcgccttttgaataatatgaagtcatgataggcgcaaacagggatgcgaccgttccggccaagctgcgcaaaagcagcggaaactggataatcgccgcgtatttcccggatgcggacgcccccagcatcaaattggcggttaacagatcaatctgcaaaaaaagcaggacgccgatttgattgacggagctccatgcgcccgcttgaaacagctccttgctagtgcggaatgaaagatccttcatacgaaacgaaaaccacggaatcagctttttgaagaaatagaaagacagcacagacgcaatgacagcaccagctaaagctgcaagctggatctgccagattttcggcgcaaagcatgcaaacaggagcagcacagacagcacccgtataagcatttgcaccgcctgaatggaactggtgatataaaggcggttggcataaaatggtgcagcaccgaaacccgccatcagaaacgttaaaataaacagcaaactgccgatcaaaatcgacaagcgcacatctgccaaaagcgcttgcggcacattcatgacgcggtcaataaaaaaagccgaacccgcaagcggcagcaagagcagcaatgaaatcaaaacagaggccgctaaataattgctgatatacgcatttgctttctcccgctctcccctgtgggcagcaacagaaaagaaccgaacgacaaccgagctgagcgccacggtaataaccgaaaagtaattaatcacattttgtgtcaagtgaacaaagccaaacgcttcgacaccgagcgttttgacaataaaaggcgtcatccaaaccgataggaaaacagacaagagaaaagccgtgagattcgcgctgaaatttatcgtgaatttcatgcctgcttcgcactgcctttcattgtcccccgctgctcgaaaaacagcttgatgagaaaagtgagccgccatttacacagtgctaataccaaacgctctcctcttaataatttctcatgctgaaacggtgtatgtctgacagcctgccgcaccatgtcataggataaaatctgtctgatcttctttttgatgtctttcggcgaattcggagaagcacaggcatttgccaaaagcatcggaagctggtgcctgcaaatgtacacattcaaatcttctttacatgcgcctgctaagccgtagtgattgtagaatgcgattttagcctgatattgtttttgaagatgttcatccatcgccggcttataagggatttctgtcaggctgttcgggttttcacgataaatgtacaatccttcatcaagcattttcacccgctccgcttcgcgaaaagcggacaaattaaagggagagtcttcagcaaaacggatgtcttcatcaaacaacagattcgccctttcaaaaagctcacgacggtaaagataacgccatacataccagataaatctcgtttcgtgagcatgtttaagctgttcagtaatttctggtttcgtcagcacgcggtttgcctcaagctgcggtggcacatatgtccgcctgtccgatgactgcttgtaaaaaccgcatccgacgatgtcaagctgattttgctccgcttcttcagtcagcctctggaacatggcggatgatacataatcgtctccgtctacaaagccgatgtaagtgccccgcgcggcctttattcccgtatttcgcgctgaactaagcccgccgtttgcctgatgaatgacccggattctcgcatcccgttttgcatagtcctctgcaatttcgcctgaacgatccggtgttccgtcattcacgaggatgatttcaatatcagaaagcgtttgatgaagcaaagaatcaatacacttccctataaatggttcaacattatacatcgggacaataatgctgacgagcggggtcattgcgcttcaccgctgattttgtcacgcagacctttaaaatacacatctctcggaaagcctgcacgggatgtttcttttgttaaaagctcattgactgcggctgttacgcgctctggctccggatgttctatcagcttcatgaacgggatgtctttaagccattgatagccctccatcaccttatggtcaaaggagcgaatgacaacacacggcgttcctgtcagcgcgcaaaaaatcatgccatgaagcctgtcagtgacgacggcttctgcgctttgcagcttagaccacagtgcttcaagttcttgttcgcgtgtatcgcggctgacccggcggccgatcgttgtcgtaaaggatttgatctcgccgaattcctcacatagcgcagccttgacccggttcctctggtcctcctgaagcacgctttcctgatcctcgcgcaaacacatataaaccccttcgcgttctgcgggggtcttgcttctgtctaaatacagcaccatgtccggctgcttcaaaattgttttttcttgaaaatgctgtttcataaattgatacgttgtttcatcccgcgccatcagcaacaggccggggtgcgcattataaattttctgtgcccgtttcagctctttgcgcccttttttcgtgtcagaaaaatgagccgttgccggaagctggacaacccgatagtcatggaatgttttaatgatgaagcggcgcgtccactcctcataacggtataaatcccccatatttccgccgccgatgataaagaccatatcctccggatggcgcgagcggatcaggttttttgctgatttgtaaatgtccttcatatcgacctcgacgatgtcaaagtccgggtattcttgctcaagaaatgccttgctggcataagcaattgcgtgatctcccaaattgtcatgggacggcagcagggtcagtatgatttttttctgatgtgctgcggcctttaccggttgatctgccgctcccagccaatattgggacgggtatttgacctttagcagcagccattctgcaaaattgattttcaacgattgtaacgacatgtcctcaccctctgtttctcattttgtactcgatcacccgctgatacacagccgatgccatcgcgacgaacggaatcattctgtatttcgccatcagaagcaggcatgaccgttttgcgtcaaaaggagcggtacccgtttttgaaagactttcttgaaacaccgggtccgcgcatatcacgccaacatttctaagcttttcaaacagccggcggctgccgttcgttttccattcattcagcatgcagatgctgctgtgaagaacgataaaggtatcaagctccttgcgatactcctccagtttgttgttctcctgtaaaaacgccgcattcgcctcatacagcgcaagtcctgattcaaacaattttttctgatagcgctgcacaatggaggaaaggtgaattcgataatgatagagcggcgtttttacgtaggatactgagcgggcgaaaaagtgagccctgaagctgaaaaactgatcctcgacatgctccagctcgcctcggagcggaaacgacagccgatgggcttcaatcatgcttcttctgtacagtttgttccatgaaaaccctctgaccttcccttcgaataacgccttgatatagtgctccttcggctgatcctgataggtttgggcaatgtctgagtccatggttttgccagtgtcctcaaactctgcggcgtaattgcaaatgaccagatcagtttcatcccctgctgcccggagcatctgctcgcaataatcaggctcaatccaatcgtctgaatcgataaacgcgataaattcgccgcgtgccgcttcaatgcctttattccgaaccgcaccgagtccctggttttcctgatgaatcaccttgaacctgttgtccattttggcgtattcttctgcgatatccgggctggcgtcagctgaaccgtcattgacaatgatgatttcaatattgtccactgtctggttccgcagtgattcgagacacgttctgatatatgtttctgtgttataaacagcgactaacagactaaccgcaggtgtttccataatgaccggctcctcgtgcataaattaccgggaaaaaatcgttctgtaaggcagaaccgatgaatcaaccggcataagcaaataactgtaaagaaaataacaaacaacgatagcgatatagataagggcgtgcgatttttcatcaaatatcctgacaaaataagggactaagatcatttgatacagaccgaaataaatattgaatctggcaaaaatcacgtcctttgttgccaaaaggccgaacaaaaaaccaagcaggcacaaattgacgacaatatcgatttgcggccacagactccgcaatcgttctttatagcaaaatgcaaggaacagcggcagaaccaaaacagcgattttgatcacattcattccatttgtgttcgtcatgagccatttttcataatggctgtatgagctgttttcaagtacaacgacaaacacagaaataaatttttgatataaaaatgtcatgccgagaaataaagcggataggccgaatatcgccggagaccaggcttttcttctgacaataaagtacaccggaatcataatcagcgccgacgaatgaaagagcgagctgaccagcacaatcaggaaatatcgcttccagttcccgctgatgatataacggatcgcccaaaacaaagcagctgcgaccatgtattgcctgatgccgttaaaagacgcgtagtaatgaaaggttcccaaaaacaaaaagacactcagctcaaacggcctgccatagtcggcgagtgtcttcagaataaagctgtaggtcacgaccgccaccgtaaaatacatgatttgaggatcttccgtgatgaaattcatcagccaaaggagtgcggtaaaccccggatctgtcgctgttttcgctgtgccgaaaccgaatatctgccacacattttgataatcgcccgccaattcgtacagcagcgtgtacgtctgaaaatccgtgccgactcgatagcggagacctgacacgagcacaagtgaagcgagcggaatccagatcaaaagcttattcggccgataccccgtggcaagcgaatcgtcacggccgccgcacattttagcgaaccaagaccaaataaatacaatccccatattgacggcatatacaatcatcggttatggtccttttccgtgctgatgttgtatacattcagcagcgctcctacattttgctgtgcatcgtagccaagttgagcgagtgtttctttgatgaactcacgcttcggcctgcctgcggcggccgcccttgcaatggtttcagcccagacgctgatcggttcagaaagacttaatcttgtgacaagcccgagaccggcgtcgactttttctgtaatgctgtctgaaatgatgcatggaagccccgacgcctgcgcttccacaagcacaaccggcaagccttcgtacagagacggcatgacaaacacatcaaatgtacgcattagttcatggatccgttcttcagtgcctaaaaagagaacatctgatagcagattctgccggcgcgcctcatcctctatctcccctcgcagcggcccgtctcctgtaagaacaagctgaaagcgaacgcctctttctttgagatgtgcggcaagcttcagcaggaacgcgtggtttttcacttcatgaaaccgggccacatggccgatgatgagccggtcggctgcaatgccgcgtgctgctttttcttcatcagccgcctgcccatttggggcgaacaactcaaggtcaatcccgtttggaagaaggtgaacacgctcccgctccatattggactgtccaaataaaaacctgcccgcatcctctccgcaggcacacagcgctgtcgcattcgccaagatgagccgcctgaacaccagcagctgcaagcgatccttccaattgaagccggtcttccaagacgtattgtgggagtggcataccctgaccggcactccggcaagccttgccgcaagggcgataaaacccgtttggaaatccgtgtgcgcatgaacggcgctgaacggcccgttttcttttatcgcgtttctcacattcctcacaaatgtaaggggattgctttgcccaatgctcgggacataaaaaagccgcccgcctaaagataaaatctcttcatcgtaagcgcacggatcatttcgatacgttaaaaagtcaaattgcactttgcttttgtccattttccgatataaattcatcaccatggtttccgcgccgcccctgttcatgccgctgagaacatggagcacgcgcttttggctgctattcatgcttgacaagcccttccttttggttcatcactctttttttatggtagcgattcatcacggctggaggcataaacgcgcggattaacggttttgcgatatatatgtaatcagataaaggaagcttcaagcgtctgcacgcctgatagacaagaatggcattgtcgattgaatacgtaaatgaccgccgtttgaatgcatcgctgtcttccctcactttatacaaggcttcctgaagattatagcccctgaagccctcttcaaaaaagcgaagccacaaatcaatatcttccattcgtctcgtccgccgcaccgaccggtagcctttcagcgtgcggtaggcactcgctctcatcataatcgtgccgtggcaaaatggggtcccttttgccatgatgcccggctccggaacagaaggcagaatgcgggcgcctcttacgccaaattcatcaaacacaagcatgccggtgccaaccacctgataatgtcggtgcttttctaaaaacgcgacctgcttttccagacggcgcggaaacgaaaggtcatctccatcctgacgtgcgatataatcgcctgtcgcatgcgaaagacaatgatttaatgatgcggcaagccgcttatttgttttgttttgaatcagtttgatgcggtcgctgtaatgagcggcatactgcttcgcgatgcggagcgtgccgtctgttgacgcatcatcgcacaaaatcagctcccaatttttataggattggctgagtatggattctatgctttctgccaaagtgcgttcgcaattataaatgcccataatgacagaaactttcggtcctgagttcatacgcttttctcctttgtatccatatccatgtacgcggaataaatatctgccatttcttccaccgttcgcgcctccgagaagcgcaaggctgtttttcggccttcctgtcccagctttcggcagagctccggcttatggtaaagctgttcaatccggcgggcaaaagcagcactgtcaccgattttgatcagaaaaccgttttctccgtcgcggatgatttcccgatgcccgcgattatctgtggcgatcgccggtttttctgccgccattccctcaagcacattcatgccgaggccttctctaatgctggatgcgacagatacatccgcaagctgaatcaactcatgtatgtcgctgcaaaagccgtaaaaacagacattggcggaggcgccaagcttttcagccaacgtttgatacgtaagttccattgccccttccccggcaaacacaaggcggagcgagggaattttttcttttagcaaggctgcggcttcaattaactgcttctggtttttgttcagattgagctcagccggataaaccaatataaaatcatcttcacggaacccgtgcttttctctgagtctttgctgctctatcggactgacaggccggaaacgctcggtattgacgccaatgccgtgaattttctccgtccttccgcccggcctttgaagtcctttcgcccgtttataatcctcttcattaatcgtaatcaggcagtctgtatatgctgaaagccatttctcgaccggatagtaaagaagccaatttttcattggtgctcctttacagaagtgaaatccgtgcgctgtgtacagcacctttgttccgtgccgccgtgcctgcctcgccgccagtctggcgagaacgccgccgaccggtgtatggcaatggacaatgtcgtattcataggtgtcaatcactttcttcagctgcctataaacggccaggttctgaggatcaaaaggtgacctgcgaatcgggatggagaatttctcatccacatacggcagcttggtttgtccgttcgcggcgacatgaacctcccagcccatttgcttgaaccatttaaaataagggaggtgaaaggccttaaaatgataatcaacagtcgcgcaaaacaatatctttttcgtcattttcactccccctaatgaacgctggcagccgtcatttcttctgatgtattgattgctgcaaacagcctcgctctcaggtcggcttccggcagctcagtgaaatcctcgataaagcgcatcagcaccggccaatcgccgtctaccgctttaccgatgtgaatttttggaaagacttgttcagcgtgaacttcatttttgttcagcaattcttcatacattttttcgcccggacgaatgcctgtgaattcgattggaatctgctctgtcgtgtagccggacaaatgaatgaggtttttggcaagatccacaatctttacgggctctcccatatcgagaacgaaaatctgacgccctttcgccagtgccccagcctgaatcacaagccttgatgcctcgggaatcgtcatgaaatagcgggtcattgccggatgtgttactgtcaccgggccgcctttttcaatctgttttttgaaaatcggaatgacgctgccgcggctcccgagtacattgccgaagcgaacagcgacaaatttggttctgctgactttcccaagattcataataatcatctctgcgaatcgttttgtcgcccccattacattggctgggttcaccgctttgtccgatgaaatcagcacgaatgtctctgttcccgacatatcggctgcttccgcgacattttttgttccgataatattgtttttgaccgcctcttctggattgtgttccattaaaggcacatgcttatgggcagctgcatgatagacaacatgcggctcgtattttttcatcaaggtaaacattttatcgcggtcctgcacatcagcgatttccgtatggaacacaatgtgtttgccgaatcgtccgttcagctctgtataaatcgaatgaatgctgttttccccatggccgagcagaatgatttccttaggctgaaacgcactgatctgacggcagatttccgagccgattgatccgcccgctcccgtgacgagaactgtttttcctttgatgcggttcgaaatttcgctagtgtcgagggttaccggctttctgccgagcaagtcctcagcttttacatctctgatttgtccggcagttcgtgtgccaagcagcatttcatcaaaatgaggcataattttaatgcttactcctgttcgcacacattctttatataacacctgaagctcatgggtgcggagtgaaggaatggcaataataatataattaattttgagcttttgcaccgcaggcatgatactttctttaccaccgattacgggcagtcccataatttctaatttatgcttcgtttggtcgtcatcaataaaagcgacaggtatgatatcaggttcatctttcgaaagcagctgcctgaccatcagagtcccacctgagcccgccccgataatcagcgcgcgggacgaggcgcagcgttttttcctgatgctttcgtttaatactctggataaaatacgggtccctccaatagacaaaagctgaagcacccagcacgcggttaacagacggaagaacatcgtgtgatacacagcatactgaatgataccggtcacagcggcggaaagcgtaatgcccttaagcaggacaatcagctcgccgagtccggtgtatgtccacacctgtttatactgattgaacaggaaagcacacacatgatagctgaggagcaagctgacagcggtaagcagtaatgctccggagtcataaaattgataggaatcttttaaaaattgatatcctgcaataactgaatttaaaacgaggtaagtatccagcgcaataatcattgacagtcttctccggtaactcaaccttttcccccctaattcttttatcggtttagctgcggcggttttcgtctctccaaaaaatcggcagcagctaaaccgacaacacgtcctatgtatatatcagataagtgggcatttaacccatcctcacgccccgccagcgacgaccagcatctaaggcagcaacttcagctgcccacagcagagccgagtgcctccattgatacaggtcaggagacatcacctttacaaaaactagtaggaatagtgttccgattttttcattttctttttgtttaaaagagcgcctaacagcttcgcattggattgttccagtgcatcttttgctttcagaacggtatcggtttttgtttttccgcttaaaacgacgagcacgctgccgtctgtttgatttgctagaatctgagcatctgcaacagccaaaagcggaggggaatcaaagatgacgaggctgaattgttcatagatctcagatattaagtctcccattgcttttgaagacagcagttctgccgggttaggcggggtcggcccgcttgtcagtacatataagttatcgatcggcgtcttttgcaccgtctcactgagtgaagcattgccgaccagcacatttgtcagcccggttacattatcaacctgaaacgtctgattgatggtcggctttcttaaatcggcatccaccagcagtactttcttttcctgctgctgcgcaaagacagccgcaagattcgctgcactgaacgatttaccttcaccaggcacagaggaggtgacgaggatagatcgcaagttggtctggacagatgagaactcaatgtttgtccgaatggtgcgatattgttccgcaacaactgatttattgtgtaaaacagatatttgagccaaacctcgccttgctttcttttttctaaagatcactcgcttcactccccgaaatgttttatcccgcgattccgccctttgtggacatcaggaacggagcctaagcatggcaatccggttctctcgctgagctgccgtgcgcttttgcaagtatcatcgagaaaatgcagaaaaaatgccagtgtaatgccgcccatgacagcagcgccaaaagccatgaccatatttcgcagcctggctggcttgatcatcgggctttcagaagccttcgcctctgataatatatgtacgccttgtacattcattctttcatctacttctttttcaaacttgttcactaacgtgttcgcaatctcagccgctttcgccggatcgtgatcctgaacggcaacgttaataatttctgattcattttcactgctggtaaccacttttcctttcagcgaggaagccgattcagataggtgcaattccgccttaacttcttccatcaaggcagtgcttttcataatcgattggaacgtgctgctatactgaagatttcgctggatgtcactgagattcgagttttcttcaccgtctgattcatgaaccagcacctgtgtcgacgcctggtaggtcggtgaaatgaccttaaattgcacaaaacccataataagggtgacgccgattgtgatgagcagaatcagcacgaatctgtgtctgacaatcgcatataattctttgaaactcatattctcattcatgtattcatagccttcagccttcccgcggctggcttcccgcgcccctttctgttaatgattggattataaaagaaaacgttattatttaaaaattgcaaaataagccaataagttctctttagagaacaaaatcatgattttcctctaatttactgcacttcccttattattttaaattttataaagaacgaaaaattccttataatgaacaaaataacgacaggaatagaggagaatttcatattatgattggaagaattatccgtttgtaccgtaaaagaaaaggctattctattaatcagctggctgttgagtcaggcgtatccaaatcctatttaagcaagattgaaagaggcgttcacacgaatccgtccgttcaatttttaaaaaaagtttctgccacactggaagttgaattaacagaattatttgacgcagaaacaatgatgtatgaaaaaatcagcggcggtgaagaagaatggcgcgtacatttagtgcaagccgtacaagccgggatggaaaaggaagaattgttcacttttacgaacaggctaaagaaagaacagcctgaaactgcctcttaccgcaaccgcaaactgacggaatccaatatagaagaatggaaagcgttgatggcggaagcaagagaaatcggtctgactgtccatgaagtcaaatcctttttaaaaacaatgggaagatgatgatcggttaagggctaacgttcgcatctatagggtaaatctgtttataatgggggaaaaagggagagaacacaatgactcatcaaatagtaacgactcaatacggcaaagtaaaaggcacaacggaaaacggcgtacataagtggaaaggcatcccctatgccaagccgcctgtcggacaatggcgttttaaagcacctgagccgcctgaagtgtgggaagatgtccttgatgccacagcgtacggccctatttgcccgcagccgtctgatttgctgtcactgtcgtatacagagctgccccgccagtccgaggattgcttgtatgtcaatgtatttgcgcctgacactccaagccaaaatcttcctgtcatggtgtggattcacggaggcgctttttatctaggagcgggcagtgagccattgtataacggatcaaaacttgcggcacagggagaagtcattgtcgttacattgaactatcggctgggaccgtttggctttttgcacttgtcttcgtttgatgaggcgtattccgataaccttgggcttttagaccaagccgccgcactgaaatgggtgcgagagaatatctcagcgtttggcggtgatcccgataacgtaacagtatttggagaatccgccggcggcatgagcattgccgcgctgctcgctatgcctgcggcaaaaggcctgttccagaaagcaatcatggaaagcggcgcttctcgaacgatgacgaaagaacaagcggcgagcacctcggcagcctttttacaggtccttgggattgacgagggccaactggataaattgcatacggtttctgcggaagatttgctaaaagcggctgatcagcttcggattgcagaaaaagaaaatatctttcagctgttcttccagcccgcccttgatccgaaaacgctgcctgaagaaccagaaaaagcgatcgcagaaggggctgcttccggcattccgctattgattggaacaacccgtgatgaaggatatttatttttcaccccggattcagacgttcattctcaggaaacgcttgatgcagcactcgagtatttactagggaagccgctggcagagaaagctgccgatttgtatccgcgttctctggaaagccaaattcatatgatgactgatttattattttggcgccctgccgtcgcctatgcatccgcacagtctcattacgcccctgtctggatgtacaggttcgattggcacccgaagaagccgccgtacaataaagcgtttcacgcattagagcttccttttgtctttggaaatctggacggattggaacgaatggcaaaagcggagattacggatgaggtgaaacagctttctcacacgatacaatcagcgtggatcacgttcgctaaaacaggaaacccaagcaccgaagctgtgaattggcctgcgtatcatgaagaaacgagagagacgctgattttagactcagagattacgatcgaaaacgatcccgaatctgaaaaaaggcagaagctattcccttcaaaaggagaataaatatggggaaaacaggatacattggtgctgccattgttgtggcagcttgtatcattattttgtcggccgtggtatgtttacgggacacagtctattaccagcctatgcgctggactggcatcatactgtttttcgcgggaattgtgatggttcccgcatactcagcaaaaagaaaacccggaaaagagaagtaattctcttttccgggtttttatgtttattataatcttcccgcgcgaatatcgtctgtcattccctcataaggagccttcgaaatcacttcttcgttgtcgactccttcatttttcagaaatgtaatttccgcaaattcaggtacaacgtattttggatacgtttcatatttttcgcgggattcttccatcaaattaatgtggtcattttggtagcaaaccgtaatttcaggatgttcatgcacccatttcgggaagaaaataatgccgtgcatgcgtttttcatttggcataaagtttaatgaaacatccgtgccagtcggctctgtccaagacactttatatacgccttctgtcagtttgacaatattcacttcctgatcccgaacccagcgtccggcaaccattccgctatgaattctataatcaattgtatggtcatttttaatataaatctcgtattcccagccgttttcatacgtataaatcatgtggcttccgataaagttttccatttttcacactctccttagtcttttactgtacttcataaatgtctagtcgaacgtaatcaggggttctttctgcggaaccgataaacaagcggtcatggagccattgatagactttactgcctgtttcaaacgtcggtaccgtacgaaaataaacatgctccggatcaatgatttccccggctgccgcttgttttcgaaacggctcgctgacttgccgtattccattgttttcaatgtaaatcagttcatgatctgctgtttcgatcacatacctggcagataaatcggttctgccgtcagcgcgaatcatttgcgaatcggcaccgctcggcaaaatacgtccctttacttccccggttattgttcccgaacgaatcggaatgaatcgtctcagtcccaggcctgtctcaccaatcgtgataggcggatcaaccttgatttctaaagaggcgaatggttttaaaaccggcttcttcacgagaaccacctcaccttcagaaaaaatcatgtaactatttacatgttcactttaacaccattgcagttaactgtcaaacaataggaacataaaaaaacaaggactgtttgaagacagtccttgtctgaagctagctttgataagcaagatatgtgctgacagtgcttttggcaagacaggcagaggaatctataatcggaatctcactttgaatatgatctaacaccgcatttaaatccgtgcaggctgaaatgatgatgtctgcatgctgactgatttcttcatatagcgtctgccacaatgcttgtgtatgctgcatatgatttggctgtttgattgcggcgataagctggttcacagcctgctgccaatggtccttgtgaataacttcttgtccatttcccttcagaactttttggtagatggcggattggatggttggctctgttcctaaaaccaccgctttttttgcgggatgcggaatctcttttatcgtttcctcaacaatatgcaacataggaactgacaatgcctgctgaatctcttcatagtagacatgcgccgtattacaaggcagcgcaatgaaatccacgcctgttttctcgagctttaccgctccgtcgataatcgcttttttcatctcgtcatggtcaattggacgatctgcatagaagggcgtcgggcatgaatagatcatcatgtgcggatagtcaatatcgtttgaagccccatacagcttctgacagtaatcaatcaccttatcaataaacggcgaggtcgatttcggccccattccggctaatattccgatcatcaaattcattcctttctacttcgtacggaccgcttcttcctctgagccatcctcatagaggataaagcttttcgcagcatcctcacctaatgtaaactcgacttcaacagacaatgctcgcagaaagaaacgggtttccgaggaaggaaataactccagtctcagctgtccggcgatctccaaataaagccgttcattctcggttgtcacctgtgcagccgtcccatcctgcaacaggtagctgccaacatagcggctgtatatcgccgtatcaattgcttttttctttttatcagcaggacgttccgggacatcatatggctggccaaatagaatatgttccgccgccttcagaatcgcttgttcatattcagtatcctcttccttattactcaaatagatcagcgttttacgatgatcgatatatcggatcatcatcgtcgaatagccgggccatcctccgctgtggctgacaatccgccctttttcaggactgttttgcagcacccagccaaagccataatcaattgtttctccattgttgaggcgcactggagaaaacgcagattccttagaagccttgctgatgaaatcgtcctgatataaagcctgatcaaatcgaaacaaatcgcttgtgacagagttaaccgtcccatctccctgtatgccatcgagatacacaacatagttcgtttcctccagctcatcagggaggacgtatgtttcggaatgtacatcatacacatatccatatgcataatgatcaattcgctcaggcgaaagcctcctgttatacactcttgtttcattcatgcctgccggtaaaaaaatacttgtttttataaaatccgcatagctcatgccagatgctttttcaatgataaccgccagcagcacataccccgtattgctgtacatccagccttcattcggttcaaaataaccagatagcccctcattcatcagcatatcgacaatatcctgattcaccgcaatcttgtgtgaatcccaattggcaaaaaaccatcccatataatcaggaagccctgacgtatggttcaataaatgccgaatcgttacgccctgatacggaaaaccgggcagccagcgatccactttatcctcatagccaagaatcccctcctcctccagcaagatgattcccaatgctgtaaaaggctttgacaaagacgctaactcaaacaaagagttggttttcaacgggcgtttttccgtcatttccgcatagccaaaagagtggtgatataaaatatcgccaccctccgcagccagaaccgtcccgttaaactgatgtttttcgcctaatgtctcaaataacgtctgaagatgctttcttttattctgcttcattcctccacctcccatatctctgtacgttactaacctactaacgtttcaaatattttgaaaaatccttcagttagagatcctttttaacccatcacatatacctgccgttcactattatttagtgaaatgagatattatgatattttctgaattgtgattaaaaaggcaactttatgcccatgcaacagaaactataaaaaatacagagaatgaaaagaaacagatagattttttagttctttaggcccgtagtctgcaaatccttttatgattttctatcaaacaaaagaggaaaatagaccagttgcaatccaaacgagagtctaatagaatgaggtcgaaaagtaaatcgcgcgggtttgttactgataaagcaggcaagacctaaaatgtgtaaagggcaaagtgtatactttggcgtcaccccttacatattttaggtctttttttattgtgcgtaactaacttgccatcttcaaacaggagggctggaagaagcagaccgctaacacagtacataaaaaaggagacatgaacgatgaacatcaaaaagtttgcaaaacaagcaacagtattaacctttactaccgcactgctggcaggaggcgcaactcaagcgtttgcgaaagaaacgaaccaaaagccatataaggaaacatacggcatttcccatattacacgccatgatatgctgcaaatccctgaacagcaaaaaaatgaaaaatatcaagttcctgaattcgattcgtccacaattaaaaatatctcttctgcaaaaggcctggacgtttgggacagctggccattacaaaacgctgacggcactgtcgcaaactatcacggctaccacatcgtctttgcattagccggagatcctaaaaatgcggatgacacatcgatttacatgttctatcaaaaagtcggcgaaacttctattgacagctggaaaaacgctggccgcgtctttaaagacagcgacaaattcgatgcaaatgattctatcctaaaagaccaaacacaagaatggtcaggttcagccacatttacatctgacggaaaaatccgtttattctacactgatttctccggtaaacattacggcaaacaaacactgacaactgcacaagttaacgtatcagcatcagacagctctttgaacatcaacggtgtagaggattataaatcaatctttgacggtgacggaaaaacgtatcaaaatgtacagcagttcatcgatgaaggcaactacagctcaggcgacaaccatacgctgagagatcctcactacgtagaagataaaggccacaaatacttagtatttgaagcaaacactggaactgaagatggctaccaaggcgaagaatctttatttaacaaagcatactatggcaaaagcacatcattcttccgtcaagaaagtcaaaaacttctgcaaagcgataaaaaacgcacggctgagttagcaaacggcgctctcggtatgattgagctaaacgatgattacacactgaaaaaagtgatgaaaccgctgattgcatctaacacagtaacagatgaaattgaacgcgcgaacgtctttaaaatgaacggcaaatggtacctgttcactgactcccgcggatcaaaaatgacgattgacggcattacgtctaacgatatttacatgcttggttatgtttctaattctttaactggcccatacaagccgctgaacaaaactggccttgtgttaaaaatggatcttgatcctaacgatgtaacctttacttactcacacttcgctgtacctcaagcgaaaggaaacaatgtcgtgattacaagctatatgacaaacagaggattctacgcagacaaacaatcaacgtttgcgccaagcttcctgctgaacatcaaaggcaagaaaacatctgttgtcaaagacagcatccttgaacaaggacaattaacagttaacaaataaaaacgcaaaagaaaatgccgatatcctattggcattttcttttatttcttatcaacataaaggtgaatcccatatgaactatataaaagcaggcaaatggctaaccgtattcctaacctttttaggaatattgctgtttatcgacttatttccaaaagaagaacatgaccaaaaaacaaaatcaaaacagaagccggactaccgggcggcatatcattttacgacgccggataaatggaaaaatgaccctcaaaaaccgatctattttgatggcaagtatcattatttctatctatataaccgggattacccaaaaggcaacggcacagaatggcgccatgccgtctcagaggatttggtgcactggaccgatgaaggcgtggcgattccgaaatatacaaacccggacggtgatatttggaccggttccgtcgtggtggataaagagaacacagccggcttcgggaaaaatgcgcttgtcgcgattgtgacacagccctcagccaaagacaaaaaacaggaacaatatttgtggtacagcacagataagggaaaatcattcaaattctacagtggcaaccccgttatgcctaatccgggcacagacgatttcagagatccgaaagtcatatgggatgaccaggataacaaatgggtcatggtcatggctgaaggatcaaaaatcggcttttatgaatccgataatcttaaggactggcattacacaagcggattcttcccagaacaggcgggaatggtggaatgtcccgacctctacatgatgcgggcaagcgacggaacgaataagtgggttctcggtgccagcgcgaatggcaaaccgtggggcaaaccaaatacgtacgcctactggaccggaagcttcgacggaaaagaattcaaagcggatcagactgaagcccaatggcttgactatggcttcgactggtatggcggtgtgacgttcgaagacagcaaaagcacagatccattagaaaagcggtatgcgcttgcctggatgaacaattgggattatgccaacaacaccccgacaatgaagaacggctttaacggcacagattctgtcatacgcgaactccggctgaaggagcaggatggaacatacagcctcgtctcacagccgattgaagctttggagcagctgactgtttcaactgacgaaatagaggatcaggatgtgaacggatcaaaaacattgtcgataacaggtgatacgtaccagcttgatacggatctttcttggtcagagctaaagaatgcaggcgtcaggctcagagaatcagaagaccaaaaacgccatattgatgtcggcattttcgctgaaggcggctatgcttatgtcaatagagcagccacaaatcagcctgacaaaagcaatacctatgtcgaaagcaaagctccttatgatgtaaacaaacgtaaggtgcatttgaaaatacttgtcgataaaacaacgatagaagtatttgttggcgacgggaaaaccgttttttcaaatgaagtcttcccaaagcctgaagataaaggaattaccctttattctgacggcggcacagcctccttcaaaaatataacagtgaaacactttgattcgattcatgaataaaaacaggggcggcgcaggctgcccctgtttttttattaggagcggtattctctgttacatattgggcattgtaaggaatataaggctggtttcaaaggaggaagcgaatgtctaaacaaggaaattttcaaaaatcaatgtcgctgtttgatctgattttgattgggatgggagccatctttggatcagcgtggctgttcgctgtcagtaatgtcgcttcaaaagcagggccctccggcgctttttcctggatcctcggaggagccattattttgttaatcgggcttgtatatgcggagctcggagccgctctgccccgtaccggaggcatcattcgataccccgtttattcacatggccaccttgtcggctacttaatttcgtttgtcacgattgtcgcttatacaagcttgatttcaattgaagtgacagctgtgcgccagtatgtggcctattggtttcccggcctgaccattaaaggatctgattcgccgaccatttccggctggatcttgcagtttgccctattatgcttgtttttcctgctgaattattggagcgtcaaaaccttcgctaaggcgaatttcatcatatcgatttttaaatatattgtgccgattaccatcattattgtgctgatctttcattttcagccggagaatttatccgttcaaggatttgcaccgtttggatttacaggtattcaggctgccatctcgacaggcggcgtcatgtttgcgtatctcggcctgcatccgattgtatctgtagcaggtgaagtccaaaatccaaaacgcaatatcccgatcgctttaatcatttgcatcatcgtttcaaccatcatttatactgttttgcaggtcacctttattggtgcaatcccgacagaaacactgaaacatggctggccggcaattggacgggagttctcattgccgtttaaggatattgcggtcatgctcgggttaggctggcttgcaacgcttgtcattttagacgccattctgtctcccggaggaaacgggaatatctttatgaatacgacatcccgccttgtttacgcctgggcgcgtaacggcacattatttggcatattctcaaaggtcaataaagatacggggacaccccgcgcttcgctttggctttcgtttgccctgtccattttctggacacttccctttccttcgtggaacgcgctcgtcaatgtctgttcagtcgcgctcattctttcatatgcgattgcacccatttcttcagctgcgctgagggtcaacgcgaaggacttaaacaggccgttttatttaaagggaatgagcattatcgggccgctttcctttatatttacagcgtttatcgtgtactggtcaggatggaaaacagtctcctggctgctcggttcacagctcgtgatgtttttgatctatctctgtttcagcaaatatacgcctaaagaagatgtcagccttgctcagcagctgaaatcagcctggtggcttatcgggttttatattatgatgctgatcttttcctacatcggttctttcggacatggtttagggattatcagcaatcccgtcgacctcattttagtcgcgatcggctcacttgcgatttattactgggcaaagtataccgggctcccaaaagccgccattgattacgataaataaagaagcaagaggttttcttgcttctttattctttacaaacatacatacacgcgataaaatgaatgagagtcagtcattgttggaggtgttcctcatgccaaaacaaacatcgggcaaatatgaaaaaattctgcaggctgccatagaagtcatttctgaaaaaggcctcgacaaagcttctatttctgatattgtcaaaaaggccggcactgcccaaggaacattctatttgtatttttcatctaaaaatgccctcataccggccattgcagaaaatctcctcacccatacacttgatcaaatcaaaggtaggctccatggggacgaggatttttggaccgttttagatatattaattgatgagacatttctcattacagaacgccataaggatattattgtcctctgttattccgggcttgcgatcgaccactccatggaaaaatgggagacgatctatcagccttattattcctggcttgaaaaaatcatcaacaaggccattgcaaaccatgaggtaacggaaggaatcaattcaaaatggacggccagaacgattatcaacttggtcgagaatactgcggaacgattctatatcggatttgaacaagatgaaaatgttgaagtgtataaaaaggaaattttcactttcttaaaacggagcttaggtactgcttaaaaaatgactgggtaacaccgctcattttttaatgccctaaaaatgactgacgttcattcataaaatagagaggtgtttcatttgaattgggttcttgtttttattgcagggcttttagaggttgtttgggcctcttccctcaaacatgccgattcgcttttggattggatcatcatttttatcttaatcgcggtcagctttatcctgttgatccgctcttatcaaaaaatcccgatggccgccgcgtacactgtgtttgtgggaatcggaaccgtcggaacatatctgactggaattgttctgggcgaatccttctcagcagcccaaatgttctttttagctttattgctggctggcattttaggaatgaaattatttacgaaagaaagcaaatctcagccgggaggtgaaaaataatggcatggtttttattagtgattgccggcatagaagaaattatagctgccattgccatgaaatatatagacggaacaagaaaaaaatggccaatcattgtgatgactgttggattcggcttatccttttactgcctttcccaagcgatgatcgtcctgcctgccggagtcgcatatgccgtctggactggcattggaagcattggtgtttcggcggtcgggctcatctggtttaaggagcggtttcagctttcacaggtgatttcactttgccttatcctagccggcgtcatcggcctgcgtcttacgtcatcttcataaaatcaaggcatatacagctgtatatgcctttgccattaagcttcgtgatgtttttgaagatgaagcggcggcgggatgagccagcctttgttttttagcaaccttaagtattttgcgccggttgccgctttcgacatatgaaattgcccaaacatcatggcaatatcctcacgaatcgattgccccatcattttgctgcatgtcacaagacctgcagcattttctgctgccgcggaagccgccacatccggatcgagaaaccgtgcaccaggcggaatatcgttaagatctgctgtcggcggttcaggagaagccggcggcagcgccaccccgttttctttcaggatcgtgctgacctgtttgatttcatcttggcatttctcaatagactcacgaagcagcttcttcaggtcgtcatcaccgacatgattcaatagcatttggtaattgccgaccattttattgcccgccatcacataactccacaagccgaatacctcaccgtaatgcatcggttcatcctgcggatttccgcttaaaatacccatgttcattctcctcccatattcaatattgcacatttcataacgtgcccaagcggaggaacatttatgtttcagcggaaaagatttatgaaatgaaacaaaacaaaaaagacaagagtggcaagttgccaaaccattgtctttcctgttgtttgattggacgcactgaagggattcgcaccccgacagacaagataccggaaaccattcaagtgctttttagtatgagtcattgattctgtctttaataaactttaacgagatggcgggatgctttgcggaaaacgaaatacattttcggggtcatatttcgcctttatttctcgaagccgcgcaaagtttgcgccataatattcttttccgaagttttcaatgttttgatctggaacattaacatatgaacctgctacatatggttgcatcagctgacgcactctttcaactgatgcaagatttgaatcttcttgtgatttatttttccaactagccgtccattccgtataaaataatggatggcgccaaaaaaaggcagtttcgtctttagggactctgcttatagcaccaccccaattgataaaaaagaaattggcttctgttccagtagcatcttccaaaaattttctcatgattgaaatgggttcgtcagaccaaaaatcatgaccccatgccgaggagaatttaacactctgatcatttctgccagggatgggttcgtcagggtctaagaaatctatagcatctggatagtataatgttttgatatctgcttctgttggagttcccgcatgtaataaaggttttaataatcgaatcaattcagttttcgaaccgaggaaaattccttctgcatgacacaaaccatttattttgctgtaaatttcaaggtagcatcctaatcgttcatctacaaacggagcccatttctgccaagctttaaataccgtttctaattgttcccacggccagataatattgaagacggttgcagttttaggggcacgatgaactttgaatgtatattgggtattatatccaaagttacctcctcctccgcctctagaagcccatagcaaatcctcattgtgagattgatctgcgtgaataatccttccttttgcatctaccgttttcagcgcgagaaggttatcacttataaggccaatcgatcgtgagagtacaccaaatccgccgcccatcgtaattcccccgattccaactgttgggctatctccaaacggagccataaaaccgtctcgagctaatccctttacaagcgggccaacgggaataccagtttgaacggttgcaatagcgttttcttcatctaagaaaactttattcatgtcactcacatcaataacaattcctccacttactactgaaaggttcttatctaaagcatggcgaccgcttctgacacgtaagggcactttattctcacgagcccatttaatagcattacttacatcgtatgaattttgcgcaaaaacaaagacaagaggatagacatccacataagggttccaattcttaatagcctctgtatagccggggtctcctttgaagattacacgccctgtcaactgtgttgatcccatatattatttcactcccaaagaaattcgattcagatactaaaatatgcaggagctggataatcgcatagacaaatgatctacgaactataaatataatacgctaaggcctttttcgtcggtgaggtctgctgagaaacatttttcaaacaattttgagcaaacttcctgtccaatcctccaacaagcgttttttcttatcgtttttaggagcagtgtccagtttttttcggagtgaatattcgtttaggccaaaagaaaagagcgatgaagaagtgtttagtaccagaggtatacatccatacaacaggctctagatcatcatatactgaatgtatgtagaaaggagacatcagctttggcaaaatatcggattatgacctttgacggcggcggtaccttaggtgctttaagtttgcaactgttaaacagattggctaggcaaaacccgaaattaattagtcgaacccatgtattttcgggaaattcaatcggttcatttactgcccttgcattagcaagcggaagatctccgagggaaacacttcagtattttgaggatgaaatcctacccgcattcagcatttcccggccaggcggacctgttttcaaccaacaattaccctattccggttttattaaagcggtaagaaattttttcccagcagatcttcaacttatagatttaagaaaacgaattgttgtcccatcattcaaattatactctcaaaaactggatcgttggactcctgtcttatttcacaattttcccggctctccctatttaaatgagaaagtaagtgatgtcatactgcggagcagcggtgctcccgcgacgcaacgggcctatcaaaactatgtggatgggtatgtagtagcaacgaaccctagtacagccagtatcgcgtttgcagttggtaaagccaacgtgccattggatcaaattgcggtattgtccatcggaacaggtgaagccccgacccggttaagaagagatacgaagggatggggaatggtaagtgcagataacatccgccccgaaaatctgaagaaccttcctccaaattggggagttcttttggacaggtcgcctaatgaacctttactgccatttcttcagatgattgctggcggtaatgggtactatgaatccatggtcagtgcgaatcttctgggagatcgttttttccggttagatccacgaattccgaacttctccaaaacggaccctgccgtcgttcccgctgtcattgaaattgcgaacaaaaccaacttacagcctgcgattcaatttatagagaagaactgggggagtaaataaatttttattttaaaactattctcacttatccaattttgtccgagagaagattctcaaaataaatacaggcaatgggtagaaccggattttttaaaggtttgttaatcacaagctaataagatgaatgaaaaaatcaattcatacttcttcttttgaaagtgagggttcaaactaaagaatgtaattgaaatgttactctaaggtatgcaattccctttttcacacaaaaaagacaagagcggcaaatcgccaaacccttgtctttcctgttgttctattggacgcgctcggagggattcgaacccccgacagacgtggtaccggaaaccaccgctctatccaactgagctacgagcgcatatagactgcgttatgagaacgtcagcacaactaattatacgataattcctttcaaataacaaccctctatttcgagaggccgttttttaaatagacaaagcatcttaattggcaatctgacatacgatggtttgaacccctgtatttttggggaaaatgggaaaaagagacgactttgcatatcaggccagctttttgtttgacctttattgaccaaaaatgtatcatgtaactacatacttacctaaaaggtgaaggaggagcattatgaatttaatacctacagtcattgaacaaacgaaccgcggggaaagagcgtatgacatttattctcgtctattaaaggatcgtatcatcatgcttggatctgcgattgatgacaacgttgcgaactccatcgtgtcacagcttttattcttagcagcagaagaccctgaaaaagaaatttctctttacatcaacagcccgggcggctctattacagccggtatggcgatctatgataccatgcagtttattaagccgaaggtatctacaatttgtatcggtatggctgcgtcaatgggcgcgttcctgcttgcagccggcgaaaaaggcaaacgctatgcgcttccaaacagtgaagtcatgattcaccagccacttggcggtgcgcaaggtcaagcgacagaaattgaaattgctgcgaaacgcattctcttgcttcgtgacaaattaaacaaagtcctagctgaacgtactggccagccgcttgaagtgatcgaacgcgacacagaccgtgataacttcaagtctgctgaagaagcgcttgaatacggcctgattgacaaaattttgactcacacagaagacaaaaagtaataacacaacctgcaagagctgcgtctcttgcaggttttttcatttaaacacttttgattctatactgctcccattcctcatgtaacagctcaagcgtcaaatcactcgtctgcctcacaaccagatcagcaccaagcatcggctgtccttgaccgacaccaaccgcaaacatccccgcagatttgattgcagaaatgcctgcttctgcgtcttctattgccgcgcaatcagcaggggaaacatcgagcatcgctgcagctgttaaaaagatgtcaggatcaggcttccccttcgcaagagccgtcggatcaacaatggcatcaaaatcatcgataattgccaaacgtcttaaaatcttaggagcattgcgacttgaagatgctaacccgatttttatattttcgtttttcaattgacatagaagcctgccaatccccggtaaaagatcttccggcgtcaatttgctgatcagcatttgataatcgcgatttttccgatgcataagctcttgtttctccgcatttgtatactttgtttccgcaccgccaaagatcaagatgctttcaagtgactcttctctgctgattccttttagcctttcattcatgtctctgtcaaaagggatattgatttgttctgcgatgtgcttccaagcgagaaaatgatattcagcagtatctgttatcactccgtctaaatcaaaaatgaccgctttcatatactaatgcccatcacagcttcataaggtttgaggctaatactctttaagtcagcccgctcctgcggatagtttgaaatcagcactttccaacgctcatgaatcagttctggaggcgcttcgaacagagccttttcttccgataaattcacaacgacaagaagcttttcccctcgatattctcgaaggtaagaaaagacctgcggatcattctcctgcaacagctgataatcgccatatatcataatcttatattgctttcgtaattgaatgagcttctgatagtaaaagaaaatcgaatcttgatcttccaaagactctttcacattgatatcttgatagcgggaatttaccggtatccacgggtctccggctgtgaatcccgcatgttttccggcatcccactgcatcggtgttctcgcatgatcccttccttttatcatcacggctttgacaaactctttttctgacatcgttttgttttcgacgactagttcacgatatgcattctttatttcaagatcatcatacatctccagcggcatatcgctgttgaccatgccgatttcttctccctggtaaataaacggcgttcctttcatgccgtgtagaaccgttgcaaatgccttcgcacattctttacgcagcttcccatcattgccccagcgggaaataaccctcggctggtcatggttctcaaaatacagggtattccagccgacattcattaacccggtctgccaccttgtcatcgtcttttttaaagcaatcaaatcaaacggcttgatctgccatttcccatttggcgagttttgttctgtatcaatatccatatgttcaaatgtaaagatcatattcagctcttgcctgcttgcatctgtgtactttttcgcctcttcaatatcagagccgtttgcctctccgactgtcatgcagtcgtaatgagaaagcacttccctgttcatctcttgaataaactcatgaagacgtgggccgttagagtgataacggccgacaatatagctgcggctgtgatccgtttcgtagtccggaaaatcggtgtatttagaaatagagccgatcacatccatccgccagccgtcaacgcctctatccatccagaatctcattacatcataaacttcccggcgaacggcttcgttttcccaatttaaatcaggctgttttttcgaaaagtagtgcaaataatactgccctgttccttcatcgtatgtccacgctgagcctgaaaagatcgatccccaattattcggctctgagccgtccgatttaggatctttccaaaaataataatcccggtgaggattgtccttcgacttgcggctttcagcaaaccaagcatgctcatccgacgtgtggttcacgaccaaatccatgacgattttcattccgcgtttatggacttcatcaatcagctgaaacatatcttcatttgtcccaaacttctcgtacatgtttttgtaatcgctgatatcatatccgttgtcatcctgcggggaatcaaataccggggagagccagatgacatccgccccgagatttttgatgtaatccagcttttgaatcacaccttgcaaatccccgaatccatctctattggcatcataaaaactgcgcgggtaaatttgataaacgacagcttctttccaccattcactcattaggcgttctcctttcacatcgtccctgtaggacaactggttcctcataaacgttcatgtgcagcggctcgccttttacaagctcaaaaataacgcgcttttcgtcaaccgtcacattgattaatcgatttcgataattgatgttgaatgaatattcgtcccattctttcggcaaaaacggagcaaatgacagcgtctcattcgcggtgcgcatgcctgcaaaaccatgaacgattgccagccagctccccgtcattgaagtaatatgcaagccttcttccgtatcatgattgtaattatcaagatcaagccttgctgtgcgcttatataattcgagcgctttcttttccagcttgagttcggctgcgagaatcgcatggacagagggcgataggcttgattcatgaacagtcatcggctcataaaattcaaagtttcgccgtttttcttccattgtaaaacggtcattaaaaagataaatgccctggagaacatctgcctgcttaataaaattggagcggagaatcttgtcccatgaccaattctgataaagaggccgctccgctggatctaattcatctactgcttgcaggtctttgtccaagaacgtgtcatgctgaacgaaaatttgcagttcttcactatacggatagtacatgtgctggatgatttctctccagactttcaattcttcttcctgcacatccagaaggcggcgtttctccgctgagatactttcgagactttgtagagtatactccaacgtccaagccgcaatgacattcgtataccaattgttgttaacgttgttttcgtattcattcggcccagtgacgccatggatcatatacttattttttcgtttcgagaagtgaacacggtcggcccaaaatctgctgactgccacaagtacgtctatcccgtattcttccatatagtctcggtcgcctgtataattgatataattgtagatcgcataacagatcgcgccattgcggtgaatttcttcaaaggtgatttcccattcgttgtggcattcatcaccggtgaacgtcaccatcggataaagtgcccccttcatccccaattttgcagcgtttcgtttggcagcctccaactgatgaaagcgatacaaaagcaggtttttcgtcacctccggctcggctgtcgccaaatacatcggaacggcgtacgcctcagtatcccaatatgcggcacctccatatttctcgccagtaaatcctttcggcccgatattcaaacgggcatcgcccccgtaatatgtcgagaataactgaaagatgttgtagcgtattccttgttgaagctcctcatctcctttaatctcaatgtccgcttttgcccatctttccttccatcgatcagtgtgcctccgttttgctttttcatagccgtactcaaccacatccgccaaaagctccttggcttttgataaaagctcttcctcacgaaaatcacgtgaagtcgtgacaatcacaaactttttcaatgatgctttcgtttgataactgtagcgattctcgacatacatttcattcgttttaaagctttcattgacaaaaccctccgtctcgtttgccatcgcggctaaaaccgtgaagcgcggtgttccaaatggattttcgatcgtttttgccgctaaatggccgctgtaagaatcagcacctttcgcttcctcctgccaaaactgttcttggtagttagaatcttcatttgccacatttccatccaggtaaggaacaagcgtaatgacagcatctcccgtcaggcattccgcttcataatgaatcgcacagagttcttttacagcaaggctaagaaaccgctctgacctgattctgacggatttatcctgaatgcggacaacagcgcttcgccgcagaatcccctctttcatattgagttctacctcaaatgattcgattgggttttgatggagatcgattttttcaccgtcaacatataggcctatgcccataaagttcatcgcattaatcacttttccgaaatattctggatacccgtttttccaccagcctactcgcgttttgtcggggaaccacacgcctgcaatatatgtgccttggtgactgtcgcctgaatagccttcttcaaaatttcctctgacccccatatagccattggcaagagacgtcaggctttccagcagccgtgtatgctccttattaaatgtatttgttttgattttccattcatcaatctcaaataaccgctgatttatcatcatttcctcccgaatgtaagtttccattatcacggcgggttttggtcaaatatctaaatgcaaaagaaatcatcaaagtaacgccacacgaatggatcatcaatacagtaatcaaatcaaaatgaaccatgccgatagcagctgccgcaaatgccggcagtgccgaggcgcaaatcgccgtagatactgcttccttgaatgacgcaatagagatcatgtttgatatttttgtgatccagaggccacctgcaagaacaaacgttaacaaaagctggatcataaagattaccgcatatgccagcatcatgatcatcggcttatactgtgccaaccataatgtatcgatcaaaacctctacatcatgggcgtttggtttctcgagcttaacgtccattttcgcatagccaacagaaaaccccgtttcgttttgatcggtgatcaccagttgatcaggttgaaatatgacggcgttttcaaatccagttactttcaatcgcccattttcaccgcttgtctcatattcatgcttcatatcgactgccatcacattctgcccatcttcaatcctctcagagctcttcccgcctgttagttttccgttcctgatttgaaaaccctgtaattgatcagcaaattgatcattaaccccttgaatcgctgacggcataaaagatgcaacgctgaagcgatccattttcacaaacgaaaccgctaacggcgccattaagcaggccgttaaaaacataaagagaaaagagagctgcagccagctgaaggtattcccatagctgcaaacacctgatggagatgcagccgctttcaggcagcggatgataaagcttttattctccagattcttcattgaattacccctttgttccgccggctgtcaaaccggacacaaagttcttttggagaaaaaagaatagaacgcatatcggcagtgcggcaaggatggcaccagccgcaaatagagctactttttgctgctgcggattagaaataaaggattgtaatcctacagcgatggtcagcctttccggtgagcgaagcaaaaactttgccagcaaataatcgccaaacggtgccataaatgcccaaagcgcttgcaccgcgagcattggcttaacaagcggcagaacaattgaagcgaaaatcctcagatgtcccgctccgtcaattcgcgcggcttcatcaatttctctcggcacagtatcaaaataacctttcatcagccacgtgttcatcggaattccgccgccgatatagatcgctgttaaaaaccagtattgatcgagtgcgcctatcagcatcgccaagacataaaaagcagtcagcgccgccattgtcggcaccatttgaatgattaaaaagaatatcaggctcttttttctgcctgcaaaccgatagcggctgtacgagtacccggcaagtgtcacaatcgtaacctgcaaaaccatgaccgatagcgcgatgacaagtgtattgctgtaccaattgagataaagcgtttcgtcaaatagccgcttaaaatgatccaatgtccaagaacccgaaaaatcgagctgaaaagccgccgaatttcccacacggaaggctgatgatgccgtaatcagcaacggatatataatgacgatacttaaaagcgtcaaaaataaatacgtacagattttattaagcattctggcagtgctcgcgttcacctacataacctcctcattgccaaaagcattcgattttttgaaagcaatcagtgaaatcccaatgacaatgaaagaaattaacagtgtcacagccgccgcaacggaatattggggtgatgtgcctgttgtcagtttataaatccacgaaattaagatatcggtcgatccggccccggctcccgcactgcctggccctccctcattaaataaatagatgatcgagaaattattgaaattaaacgtatactgagtaatcatcacgggtgctgtggcaaataaaatcatcggaaatgtaatatgccgaaaacgctgaataaaagtggccccgtcaatctttgccgcttcatacaattcacctggaatcgcctgaagcactcccgttaccatgacataaatatatggaaagccgagccacgtctgaatcataatgagggctgtctttgtccagaaaggatcagtcttccacgcgatcgcaggcagctcaacaaacggcaggtgattgaatagtggaatcacctgtgcattcaccgctcctatgctgtcgttaaacatgttggaaaaactcatgattgtaataaacgccggaacagcccatggaaataagaaaatcattcgaaatatccgcttgccttttataaaatcctgattgacgaaaagggccgtcacaatacctaaaatgatttgcagcgttgttgcacagattgtccagataaccgtccagcccagtacattcacaaatgtttcacgataggagccaaggaaaaaaatattcaagaaatttttaaacccgacccagtcaatcagacgattaggcggaatatgataaaaatcatagtttgttaatgcaacaaacagagtcaccaaaaccggaaagataatcacaaacaccatcatgatatatgccggaagtgtaaatagatatggaaaccctttatcgcccgcatgacagatcatatccttggctgttgtattgacttccaaacccgccgctttcatagcggcggtcttacgcgaatcatgaatattaaagatatagaacatgaggaaaatcattgtcacgatcaattgcagcgtgccttcaatcagcataaacagcgagtgatcttcaccgggaacacttcccaatgtcatcaatccggttagcgcctgtataccgaaaacgcataattcaaaagcaaacaagcctgtgatggcaagaaataagagcccctttgacaactgctgattcgcaatctgcccaagtcctggaatgatcgataaaagccctgcctttcgtttttgctttgcaagtgtgtgatgtttattcatttttttccgccctctattcttccggacgctatcccgccgttttatttcacatacttttctttaatattttcctttatgacgtttacagcatcattcgctgatgtttgtgtcgatttttttcctgaagctgcatcaaaaattaaactttccgctcctgtccatacttcagccatttccggaatatttggagtcggcgtcgctgtttcatattgtttaatcacagctgacgtcagttcattcttttgctcatcggctttcttccttgcggccgtgttggccggaacttcgtttgtattctgataaaaagcgtaagcattggcatcatttgcagcatactcaagccatttttcagccagctcgggctcttttgtatattttgaagctacccagcccttcccgcccgcaaaaggggcatattcttctccattgggcaatgtcggaatgggagccgctccgtagttcaatttagcctctttataattggcagctgaccaaggaccgccaatgatcgcagccgctttgccttctaaaaacatctgctgaataaagtcgtctgcgcttgaattgtcttgcattcctttcggccaatatgtttcaaaccatttctccgcatatttcaccgcttctacagctcctttattgttcaggccgatgtccccggaatctgtgccgttttttccaaacacatatccgccgtatccagccaataagccgtacgacatataaaagtcagtccattttgctaaaaatccggttgattttcctttttccgaaacaaacgcgaatcgaggatcttccgttaacttttcaaggtctttaaatgtttttggcgctgtttttaaaagatctttgttgtaatacaaaataagtgtctcaatgactagcggcattccgtacactttgccgtcaactgtcacctgctgcatttctttatcaccaaagctttttgtatgagatggcttaatgtcaagcaaatgtccttgctgtcccaaaccgccgatccggtcatatgcagcaagcataacatcaggcgcattacccgccgggccatcaagaggaagcgcttctaactgttcgaacatttgcttttcaacaatttttactgtgacatcattctctttttcgaactttgtttttatgctttcaatgtattctttatacgtttcttcgacagacacagtcagcacctttttgccatcagagcttgctggattttttgaacttgagcaggcggcaaggccgattgccagaaatgatgccgccaatatggcgaacccctttttaaaaagaaccatctcttttcccccttctatttacgaaactataacaattgtattgtcctatagaaagcggttacaacaacttttgatttgttaccgataacagaatgttatacaggggcggcagcactcaaaatcaaaaattctcccggctgaacggcaatgacatcgtgataatgaagcggctgctctgtccatgcatcacagattttgttattcctatcaatattcaactctcgtaaactaatgtgttgaaccacattcccttgattaaagaaataaatcagtattttttcatcaagagtccgcgaaaagctaatgaaatcatttttgtcgtccagcagattccactcaagatgtccttcagtcaataaagtgttttcctgcttgcgtaaagcaattaaccgtttcataaattgcagcatgtcttggttttgcttctccttttcccaaaccatacatttccggcataatggatcattttcgccgtccagcccgatttccgtcccgtaatagatgcatggtgagcctgtctgggcaaacataaaggccagcaacgcgcgtgctttcttctcatcattgcggcatctggtcaaaaggcgctttgtatcatggctatccagtaaattaaacatcacctcattggcctgcttcatcccattcatcaaatgtgcattgacacggtgagccatacgtgaagctgagatcgtctggtcagcaaagtattcaatcataggctctgtaaaagggtaattcatcgccgcatgaaattcatcccctctaagccagggttcggcagaatgccagatctcacctaaaatataaacgtcaggcttttcagtagatacagcctgcctaaatgtcttccaaaacacgtgatccacttcatttgcgacatccaaacgccagccgtcaatgtcaaattcgcgaatccagtacaaagcaatatcaagcaaatatttctgcacctcgggattagccgtgtttagcttcggcatatcagctgtaaaagcaaatctgtcataattgtcgtctgtgacgggaaaagagtgaatatggaaccagtccttatagcgggattgatctccgtttttgacgacatcctgccattgcggagacgcgcttcctatatggttaaaaaccgcatcaagcataattctcatcccccgctgatgcagctggctgaccaatgtacgaaaaatctctggatccccgaaatgcggatcaatagaaaagtaatccagcgtgtcgtatttatgattagaaggcgcggaaaagatcggcgtcagataaatgccgttcacccctaaatcctctaaataatcaagcttgtcaacaatcccttgcaaatctcctccaaaaaaatcattgacgcccgggtccttgctcccccacggcaatgcattcttcggtgacaagtcttctcttccatttgcaaaacgctccggaaaaatttgataccaaaccgttgacttgacccattcaggcgcttgaaatgtatcagcctcgtgaacaaacggaaatttaaagtaataatgaatcgtttccagtgttttttcgttataagggcatacacccgaacttccgaaaaagatgtcttcatgatcgtctgttacaacaaacgcatattgtaaacgcctaaatgggggcaccacttcagcaaaccaatagtcatgcatttctgttgcagcaatttttctcatcggctgctcgtttgccgaccatttgccgtcgttgtactcatagggatcaccccaaatgaatcgaatgtgatctgcatcaccttttttcgtccgaatcttgatatgcacagtccgcccatcataagaataagcatctgtgctgaatggctggtggtgaatcgctgcatattccatcatgtttccccctttgatttccgttttattgaagccggctcatagtttgaaagtatcatgatgaaattgtgggaacaatccttttcaccctgttaccgataacagaataaggcgcttacagcgttgattctcgtacaattaactctggttcaaaaaatagacttccttgtgcagcaccgtcttcattcatttttttcagcaacattttcgcacaggcttcccccatttcaacaacaggctgtctgaccgtagtcaagcgcggcgaggagatgcgatcaagaaacacaccgtcattcccggtaaccgcaacgtcttctggaattctctttccaagggattgcgccgcacgaatgacgccgagcgcgattcgatcagatgcgcagacaaatgcggcttgattgtccatggatttcagcagttctcttgcaaggccttcacttttcttagaactgttgtcgatccgaaacatattcgattttttaaagcttttattcatcgcccgtatatacccctgttctcttgcacgttcgaaaggctcatctaaatcaatgccaaaaaagacaacttcccgctccccaagccccataacatggcgggttgccataaaagtgcctttctcgttattcacatcgataaagtcatagcccatttcattttgcccaaatacgacgagcggcttctcaaacgcttttattacaccttcaaaatcgttctttctcaagccggtggcaataatgccgtcacattggccaatattaagagaatttcttgttacaagctggagagcatagtgattgcgatccagctccctgctgattcctgtcagcaggttcatgtaatatggttctgtcgtatccatttcctcaagtatcaatagtttcacaacctgtgttctgttttgcacgagcgctctcgccgcataattagggatgtaattcagctctttcatcgcagaatgaacaagctttttcaattcatctgtcaccgtctcagggtgattgatcactcgtgataccgtcatcttcgaaacatttgctttttttgccacatctgacaatgttgccattttcatcccctccttatctgtgcttattatccaaactagtgataaagtcctctattactgttaaatatacgatgcaggcaaaagagaaataaaaaagagatttcccttaaggaaacctcactttgttaaaaacactcgatttttcatggattcatacgctaggttgctgactcattctctccacttccatgagaaaatctcttttttaaatttctgtccactttttttctaaaatcggataagaataattttgcatttgctcaattaactcatccggccgtgacgagctgtgaatcagttttaggtgcgattcgttagaaaacccttcttgaatgctgtatttcaccattttcatcattggttcaaaatatccgtttacattgtacagtccgattggcttttggtggatgccgatctgtgcccagcacagcacttcaaataattcttcatatgtaccgaagccgcccggcatcgagataaagccgtccgccagctcgctcattttagcctttcgttcatgcatcccgtttacttcaatcagctcagtcagattctgatggacaacctccccgctgaacaaaccgctcggcatgaccccgattgcagttccgccgttttccataatcgcgtcggcaatcgtgcccatcaagcctacgcgggagcccccatagacaaggccgattccctgctcagccatatacacgccaagctctgccgcttttcttttatacgcttcatttcccccagggtttgatcccgcaaatacacaaatggttttcatcttgtcatctccgcatctatatatcgtgttaaacattcaaaaacacactatatattgtcccatcttcatgtgataatatcaatatgaaatacataaagaatgcaggagtgatgaggttggagctggctgatgcagaaaaatggatgaaagagttttacgaaaaaagaggctggacagaatacggaccttttattcgcgtcggctttttaatggaggaagccggagaactggcccgggctgtcagggcgtatgaaatcggcagagaccggccggatgagaaagaatcgtcacgcgctgagcaaaaacaagaattgattgaagaaatgggagatgtcatcggaaatatcgccattcttgctgatatgtatggtgtctctttagaagacatcatgaaggcacaccaagaaaaactgacaaaacgatttgaacatgcataaaaaagcggccgcgatggccgctttttttaacctgtgatttcatcatgatgatcaaagaaatgctgctttcctattttgtgaaaaaggcctgttttatgcagcagctcctttggctgcgattgcaatcctacaatcatcagctttccattgtggcgtttaattcgattcataatgttcccaagcaccgcttcagctgacgtatccatatagtgcaccttattcatgagcaaaatgagggttttcggttttttctgtacatgctccagcaatgacgattcaagggaatcaattgatccgaaaaacagcggcccttctatggcatacatgctgacagatggatcttctctcttcgccagaacaggatgcgattcctgattgtggatgcgggtcgcttcgctcattcttctgataaagaacacgaatgcaagcagcaatccggttgccacaccgatgattaagtcaaacagaaccgtaagggcgaaggtcgccgccaaaataaaggaatcagcatttttcagtctcagcatgtttgcgacttccttgcgctcactcatattccatgcgaccaccatgagaatcggtgccatactggcgagcggcacatgggacgcataaggcgcaaatacaagcaggacaaggagaacgactacgccgtgaacgacgccggaaactggggaaaccgctccgttttttatattggtcgccgttctcgcaatcgctcctgtagccgggattccgccaaacaggggcgctgccatattcgcaatcccctggccgacaagctccttgttgctgtcatgctttgagcccttcatgttatcagcgaccattgcggacaaaatcgactcaagtcctccaagaagcgcgatgacaagcgcagccggaaacagcataaccattttatccaaagtaagctcaggaaactgaaattccggcaaatggcgggggatttctccataagttgacccaatcgttgccatgcggtcagggaaaaagacaaccgcgaccactgtggaaataagaagcgccaacaaagcgcccggcactttaggcatcaccttggcggatacaagcaaaatgacgagcccgatcacagctgtcaaaatggcatacacgttaaaggtgccgagctgctgcacaatttcaaacatgttgtgatgaaagttctcatgtttttcaacatttctcaatccgagaaaattagcgatttgttccgtaaagatcagcacggcaattccggctgtaaaaccgacgataacgggtttgggcacgaatttcattatttttccgagcttaaacagcccaaacagcaccagcatcactcctgccataaaccccgcaatcagcagattttccaagccgtactgcatgacaatgccgaataaaatcgggacaaaggcgcccgtcggaccgccaatctgatattttgatcctccaaacaaagaaatacaaatccctgctataacaacagtgtacagcccatattcaggctcgactcccgaggcaatggcaaatgccattcctaaaggaattgccacgacacctactacgatacctgcaatcaagtctttctgaaatttctgcaaattgtatcccttgaatctccctgagaatcgcatattttattataacctcccttatgagtgattgtttataagctcagtttcataaccgttaatgaccacatcaagttttcctgtttcaggatgaatgacaagtccgtgaaccggcacttttttcggaagcagcggatgattcttaatcatgttcacactgtgggaaacgctttcttccacgctgtgaaaaccagtcagccacgttttcaaatcgagtccggcactcgtcagcaaattcaggcagctatcctccaccccgcgttcctttgctttctcaagaatcgaggacgcattcagcccagacattccgcattcatgatggccgacaatgcatacctcttcagcctgcaattcataaatcgcgaccagtatgcttcgcatcacgcttccaaatgggtgagaaacgatggctcccgcgttttttacaattttagcatcaccgtttttaagccccattgcttgcggaagaagttctgtaagccttgtatccatacaggtgacaatgacgagctttttcgaaggaaactttgtcgttttgtacggttcatacttcttctcactgacaaaccgctgattgtgttccaaaattgatgttaaagaaaccatttgattcatctcccatccatatgattttgcaagccttcttacccagcttacagtaaggaattatagcataggaataagccaagaaaaggttttcaaaaaaagacactataattggactgtagaatcaaaacataaacatttatatctttcaaagataataaaatttatatttaatgcatcctataatccggctgcagttcgtatatcgatgatttgtctgacaaaaaatatgggtgaattctgataattaaaaaacttttttaagcagatttagctgttcgatcttcattttaagttcaaaagaaccagaaattaaaaaaacgcagctatatttttaacatctatttattttcgatataatgaattagacaacagccataaagggggagccttgttgaaaccatttgtatttatcacaaaaccgattcctgaagagattgaagcattcatcggtgaacattgccgttatgaagtatggcaggaggatacgcttccgagtgacgtgctatttgaaaaattaaaagaagcggaggggcttttaacatcagggacgtccggaccgtcaatcaatcgtgagttgctggaacacgcgcctaagctcaaagtggtcagcaaccaatcagtaggctacgataacttcgatatagaagcaatgaaagaaagaggagtcgtcgggactcatacaccttatacactggatgacacagttgcagatctggctttttcactgattctgtcttccgccagacgtgttgccgaactggaccgttttgtcagagcaggaaaatggggaaccgtggaagaggaagcgcttttcggaattgatgttcatcatcaaacgttaggcattatcggcatgggcagaattggagaacaagcagcgagacgcgccaaatttggttttgatatggaagtgctttatcataaccgacatcgcaaacaagaaacagaagacagcatcggcgttaaatatgcagagcttgatacattgctggagcaatctgattttattcttctcattacgccgctgactgatgaaacctatcacatgataggagaacgcgaatttaagttgatgaaggattcagcaattttcgtcaatatttcccggggaaagacagttgatgaaaaagcactgattcgcgctcttcaggaaggctggatcaggggagccggcttagatgtatacgaaaaagagcctgtcacccaagataatccgctcctgcagctggataatgtcacgctgcttcctcatatcggttcagcaacagctagagtgcgcttcaacatgtgcaaacaggccgccgaaaatatgatcgcagccattcaaggacaaacaccgaaaaatctcacaagagaatttcaataaatcaaaaatccggtctgataacagaccggatttcatattacatacgctgaagaacagcacgcttataaatatgacgggtgacgatataataaagagcctggaatacaaaataaatgaagatgacaattacggcctcaagaaataaattggaattcagcatattacttaacgctgcatacgcaaagcccgcgtgaatcgtacctgcgataaatgggatgaagaataaaaatcctatttgctttccaaggatcgagtgaatctctttgtccgtaacccctatcctctttaacgctaacacctgcactctcgtatcttctatttccgtaaacatccgcaaatacagcatgcttccttgcacgataaaaaacagcacgctgacaaacagaccaataaacagcattaatgcaactccctgctttacaatttgataactaggagcacgtgtttgaaaatcagatgtatgttctttcggcaccatgttttcaagcttttcagagacatccaccgtctcctgccaatgctcaagctcataacctaccattctcatctgttccttcagcggcacatcctgtgacagactgtcaaagctcttttcgctgacaaccaataaacggctgactccatcgacagacatcaatatccctttgttttgctgctttttcatgacgtaggaaagggtttttcctgacttcatatgaaatgctgctgtttccccttctccaaatgtgtctttcaccatcatttgaaaagaaacattaataaatgcttcattttcttgtaaatgaataactgggaaccctttttcctttgcgacttgattatagactttttctgaaatcagcagagcttccgcttccatcttcttatttccatacggcaagtctgattgaaaagtgacaggaatccctgtggcatccaccttatacttgataacagcatgagcttttttcaatgtattctcagccgtctcaggcttcatgacctgaaagcgggaagcatccttttccacccaggaaacagactgaggaatgctttgctcctcctgcctttgtaaatcggaataaaacatatagatgacacctgtagctgttagtatgaccgctgtaatgacagaggttaaaaacagcatgcgtgcatgatccttcagcctgaatatcatgttggaacgcacaatgatatttgtgcctttgtagaagctgtgtttctttcggtacagcatgcggaaaaatgccacactgctttgggtaaaaaagaaatacgtgccaattaacactaaaatcaaaattggaaaaacccgaaacatcatgtcaattgcattggctgttgcagatagataataaccgctgccaagacatagcaaagacaatacagtgagccatttcgaataaactggcaaacttttcggctttttggctgatttaatcagttcaatgatttccagcttccgaatccgtcccagtgataaaatgagcagcgtctgaaacaggatgagaaagccggcaattgtcatcacaaacgctttcggcacaatggcaaacgaaatcggcaccttcacgctgagcatccatgtcatgatcataaaaaacagttttgaaaataacaggcctgctccaatgccggccgcaatcgccgcaagagaaataagtgactgctcataataaatcatcttgcgaagctgctgctttgatgtgccaaacagtgtcagcagcccaaactctttctttcttgcctgcaaaaacgctgaattggaatatgtgatgaaaaatatacaaaacacaatgatgacgacaagagctgcgctcaagcatgttttgacaaggcttcctccatatatattgtcttcattgacatcaggatgaaaaataaatgatgtgaagacaaaaaacaccgaaacggcaaacacacagcttaaaaagtaggccacataccgttgcagattcccaagaatgtttttacgggcgatagttctcaaattcatgaaaatcgcctcccaacacactcaaggtatccaatatactttgataaaacacctgcctgtttgttcctctgtgaatctctgaaaagaaacgtccgtctttaataaaaacaatccgtttacagaaacttgctgctgtggcatcatgcgtaaccaacaaaatcgtcgcttccttttcctcattcagctgagccagtgtgttcatcacttgctttgccgattttgagtcgaggtttcctgtcggttcatcggcaagaatgagcgccggattgtgaataatcgctctggcacaagctgcccgctgctgctgtccgcccgacacctcatatgtgcggtgatcgagaatgtgctttatttgcagcgtatccgccagttcatccaatcgagcttccatttctctcagctttaccttatccaatgcgagcggcaagagaatattttcacgaatcgtcagcgtatcaagcagattaaaatcctgaaagacgaagccgagttctcttctgcgaaacaaagccagctcttggtcctttaacgttttcggctgaatgccgttgatcatcatctcgccctgggtcggcttatcaatggtagccagcaaattcaaaagcgtggtttttccgcttcccgacggccccataatcccgacaaattctccttttgacacactgagatcaaaggcgctgagcgcttggtatgatattgttcctttatttgaatagtatgttttcgataggttcgttgtttgcaacacgttcatgttctgctcctcctttttctttattataaaaaggaagtcagcatcctcccatcgaactttcttgcaattccgctccccaatcttacaatgctgtcacattcacgagggtgtcacttgaaaacacgatggtcatcacagtgccagccccttcttttgattccgcatacagcttatggccgagacggctgcacacctgttttgctaaataaaggcccattccagttgcctctttcatggttcgtccgttttctccggtaaaaaacgcgtcaaaaatccgcggcagatcctgcggcggtatgccgattccttcgtcgacaaccgacaagcgcgtctcatgtccctgtgtttcaatccggattgtaatagggtctcccacaccttgctttgaatattttaaggcgttgaaaaggatttgctcaacaacaaaggaaagccacttttgatcactggaaatctgaacggcatttggcggcacatgtaatgttggaaaaaggcgccgcttgataaactgacgtttttcctgattgatcagtgaacgaaccatttctgccaaatcaaaggtttgcggctttacatcaaatgcaaattcctccagccgggccgtttgcagcatcatatcaagaccgtggcgaaatctctcattctcatcctccagctcctctaaaaacgtcgaaaaagaggatgaggttccgttttttccttcctgaatcattaaggatatgacggataccggtgttttcatatggtggacccattggttggtgaaggtataatgctgtttttgctgattgatatattgtgagagcctgctttcgtattgctgcccgagtgcgttgatcattttcgtccaaagcgcttgctctcctgttcttggctttctggctttcaaagactgtccgatgtcattcgaagaagaggcttgttctgcaagctttttaacatatgtgagaaaggaaaattgccgaacataatcagcagcaaaacctgcggctaaaagagtaccgggcaaaatccatatgtacatcatattttctttggaaggttctgcgccgctctctacaatgcttaaatacgcaatcagcatggcggatcctatccctaataatgaaaatagaataatggctaagcggtcgatgagataagtctttaacactccgcttcatccttccgattgacttgaaattgatagccttgtcctctgattgtggaaatgcaatctttcagtccggcattctccagttttctccgcagccggttgacattgaccgttaacgtattgtcatcgacaaaatcaacgtcatcccataacgcctccaatagttcatcacgagagacaatttttttatgctccctcacaaaaatagagagaagctgaaattctttttgggaaaacagaatacgggagctgttccattcggcctcattttgatcaggataaatcgttagcccgccaagctccacttttcttgattcctgcggcaaagagggcgagtattcaccatatgtgcggcgcaggacgcttttgattttggccatcactacctctaaatggaacggttttgtgatataatcatcgccgccattttcaatcgccattacctgattcagctcatcagtccgcgctgaaataaaaataattggcgcattggaaatggtacggatttgcctgcaccaataaaacccgtcaaaaaaaggaaggttaatatcaagcaggacaagatcaggcttcatttctgcaaattccaattttatatcattcagctgttcagcaattttcacttcatatccgtatttttgaagatgaccgcccagcaaagaagcaatccgctcatcatcttccacaagcaaaatccgatacacgttgatcccccttatatgtacatctcgatgatttttctagaagattccaaaattattatagcatgtgcggaatagtaaatcggtctttttctttttgttatgatagaatgataaaggtaaaattttcataataggcaggtgtcgtgatgaagaaaatcatgctgtttctggcaatgacgtcaattctttcagcatgtcagcccaactataccgggaaatacatagaaattggggatacactaactgactataccaaagagtgctttaaagagaatgaaattccttataaatacgaaaagggaaaactgtatatcccagaagacgcatttgatacagcaatctacacttgttcataagaaaaagcttgcagataacctgcaagcttttcacgttacaaaaaatgagtatttaatttctcttcaaatcctgaagggccgatgtcgcttttttgaatgttaccgccgttttcataaatcgtaaaatggcgctctgacatgaccatccttccgctcggcgtcagctttgaggcaagcagggatttgttaaaaggagatttttcatgagagtgaatgatgtccttcatgttatctaaatcaccgagatcactctcttcaagggtaaaggcgtacccaatttgccagccttctcctttgtccatcagcagaacatagctgcccttttctgtctcttcctttttgattcggaatgacccgactggtgactgtaccgtttctccggaaagcggtatcggctggagcgccaggttgatgccgaagccgatatcaacgaggtaatcgccgttttccgcagacagccatacagcagcatgcgtcccttctagtgcccatccctcttgatcgcctgcataaaccgttcctcgaataagcttcacatgaaacccggcctcacgcaaaacaaaataaaggaaaccatttagatcgtagcataggccaccgtgctgatctttgagcagacggcgccatagatcttcttttgttaccctataattctcttttgcaagtacggcacggttttcgaatggaaaacggtatgccattgctttgagaaaaaggggaagatcgccgaagctgacatggtctttctcccagccgattttctgaaagcagtcttttagaaagtcactcatttttatcacctaaacttcttcttgaacgtaagcagccagcttctccagcgcctcttgttcatcttctccctgggcaatcaaggtaacctcagtgcctgtgcttaccgcgaggctcatcagccccatgatgcttttggcgtttacttttttcccatccttctcaagaaacacatctgacgtaaaccggtttgcttcttgtacaaacaaagcagcaggacgtgcttgcagtcctgtctttaatcgaacttccactttctgttgaaccataagatctccccttttctttacggttattttaaagtgacggtttgccctgtccgcagctgttctgcgatttcgtcaagttttctcagcctgtgattgatccctgatttgctgattttcccgcttgctaccatttcccccagctctttcagcgtcacttcctgataatcaatccgaagctgcgcaatttcccgaagtttttcaggcagcgcctccaggccgattctttcatcgatgtatttaatattttccacctgtctcagcgatgcgccgatcgttttgtttaagttggctgtttcacaattgacgaggcggttgaccgaatttctcatgtcccgaacgattctgacatcctcaaatcgcagaagcgaattgtgagcgccgattacgttcagaaactctgtaatcttttcagcctcttttaaataggtaatgtagccttttttccgttcaagcgttttgctgtttaactgaaactcatttaacaggtcacataatgaatcgttatgctccttataaagagagaagatttctaaatgatacgaggaggtttccgggttattgaccgaacctcctgccaaaaatgctcctctcatataagaacgcttgcagcatctctttttgaccagctctttcgaaatacttcgttcaaacacaaaattctccccgagtatttttaaatcctctaagatcgcttttgcattttctgaaaaacgcacaatatagacgttattctttttcagccgcattttctttctgaccagcagatcgaccgacacatcatattgttttttcagcaatgtatagatgcggcgggcaatcgccgcattttcggtttgaacatcgagtacgagatggcggtttgtaaatgataaagctccattcatccgaatgagtgcagacagctcggcattaatgcagcagtccttcacttccagattcgttaattctttttttgtttctgatgcaaatgacatatagccacctcatttcaaggcttcattctttcagtaaatcaacaagaagagaggccactttatgtgtatcgtgacgtattacgtcatttttatacgttacaatttgatctctgatgacttcaagccccatcgctttcagctcttcgatatcaaaatcaacaggacgcgccgattccatttcgtacttacgttttatttcgtcgggaatgtcttcactgttcactaatatcgtatcaataaaaccgcagcccatatgctgattgagcgctttcacatgatcagcagcggtgtaatggagcgtttcgccgggctgagtcatcacgttgcaaatgtatacttttttcgccggcgcctttatcacttcttccccgatttttgggacgagcaaattgggaagaatgcttgtatagaggcttcccgggccgataataatcaaatccgcttccctgatcacgtctattgtttccggcagcggatcaatctgttcaggcgtgagaaaaacacgcttaatacgctgtccgtattccgggatcgttgactcgcctgagaccacgcggccgtcctccatctcagcatgcaaaacgacactggcattggcagccggcaaaacctttcctcttacattcagcaccttgctcatttctgtgacagcgtgaaaaaaatcaccggttatatttgtcatcgctgccaaaatcaaattcccgagagaatggcctgttaagtcattccctttattgaagcggtgctgaaaaagatcttcaacaagcggctccacatcggataaagcggcaagcacatttctgatgtctccgggaggcggaattttcagttcattccgcagacggccagagcttccgccatcatcggcaactgttacaatggccgtgatgtcaacaggtttatgctttaggccccgtagcaatacagaaagacctgtaccgccgccaaagattgcgattttcggcttttgtcccatcttatttccggcttctcttttcaatgtcccggtgagtaacatgagtatagtaatcctttttgaaataatcagctaaattctcggctaatgtcacagagcggtgctggccccctgtgcagccgatcgcaatgacaacctggctttttccttctcttttgtaagatggaagcataaagctcagcagatcaattaatttctcattgaacttttgtgtttcattccacttcatgacgtaagaggaaacctctttatccttgccagtcagcggccgcatgctttcgatatagtacggattcggcaaaaatctgacatcaaagacgagatctgcatcaattggaataccgtatttaaaaccaaatgacatgacattcacggtaaatgtctctccttggtttgtcgcaaagtgcttcacgattttttcacgcaaatcacgcggcttcatgtcagacgtatcgtaaatgatttgagagcggccttttaattcctcaagcagctctcgttccagcgcgatgccttcaagcggcaggccagtcgctgccaaaggatgcgagcgtctcgtttctttatatcttgtgacgagaatggaatccttcgcgtccaggaataaaattcgcggtgtgatccacggattttcggccatttcatccagcgcttcaatcagccggtcaaaaaattcgcggccgcgcaaatccatcacaagcgcaactttgctcattttcgaatttgattccttcatcagctctaaaaacttcggaagcaatgaaggcggaagattatcgacgcagaaatagccgagatcttcaaagctttggatcgcgacagttttcccggctcccgacattccggttataatgacaagctgaatatcatgtgattcactaacactcatctttctcccccctgacttgtctttctatttgatgtgctgcgggtctaaacgataactgagcagctcaaattccggtgtatacgtaaatgtgccgtgcagcagcccttgtcccttcatcataaaatcaaggatatggccgtctccaggggccataggcaggctctgaatgtcattgacatcgtgccactgcagtttgccttcctctgattctgatacattttgtcctgtgtatgaatcagcgacaaacgtaaacatcatccactcggagacaatgtggtcaccgtctttaataataaaggtaaaaacgccttttaattgaggatttatgatatagataccagtctcttctctgtactctctgatgacggagtctctgactgattctccgctctccatcttgccgcccggggcgacccaccagccgcgtctcggcttttgaagcagaagaactttgtcgtccgtctgaagcacacaatttgtcactctttgcaagtacgtcacctaaccttcgtcctgtcatcgtctctttattataccgcttcaagatgcctcccacaatgaagagacattgacaatcttttcttctattttacagcatattcattccttaattcagatgattttgctgtaactggcattcatcttttatttatggacaaaaaaaggacacggataactggagaatccgtgccaaaaaagtgtattcattataaaaagggggtcaattactttattaatcataaccgaaaagcattacacatgtgttacagcggaattaaaacccagtaacgtaatgtgaaactcgtatgacagccctttttattttaaggttttcagcgtttcttggagctcttcgacataatgttgtacgctttgtgccgcaatgcttccgtctcctgtagccgttacgatttggcgcagtgatttttcgcggatgtctccggcagcgaaaatcccttcaaccttagtttccatgcggtcgtttgtttcgatatagccttcttcattcgtaatgcccaggttttcaaacggtttagacagaggaagcatgccgatgtaaatgaatacgccgtctgttttgaattcactttcttcaccggttaccgtatcgacaagcgttacgttaccgactttgccgttttcctcatgaatttccttcacggttttgttccataggaagtcaactttttcattatcaaatgctctcgcttgaagaatactttgagcacggagtttatcacgtctgtgaacaatcgttacttttgaagcgaaacgagtcagatatacgccttcttcaaccgcggaatctccgccgccaacaacgactagttctttgcctttaaagaaagcgccgtcacataccgcacaataagatacaccgcggccgcccaattctttttcgccaggcacgccgatttttttatattccgcaccagcagcaatgatgacagcacgtgctttatattcctttgaaccagctttgactactttgtactctttgccgtcaacgacttctttaatatcgccataagcgtattcagcgccgaattttttcgcgtgttcaaacattttgttagaaagctcaggcccaaggatactttcgaatccaggatagttttctacatcttccgtattggccatttgtccgccaggaattcctctttcaatcattaatgtcgataaattcgctcttgatgtgtatacagcggccgtcatcccagcagggcccgcgccgattataatcacgtcataaattttttcttctgacacactattcactccttaaaccatcttttcaagtttgggctctttcttataagataagaatccccatcaaacgtattccttacccatatcctataaaatctcatggtgatacgctatttttttgctcaacacgattaaatgtattcgaaaagggtatatgttaataaagaaagagccttctgttttagaaggcccttgtcatatttattattgaacaacacgtcttacaacgcctttaaatgcttttttccagtaaggattgctcatagagtcaacagatacgccatgagatgtattgtcgtttaggaaagtaccgtttcctaagtagattcctacgtgtccatttgttttgtaagtgtcaaagaacacaaggtctccgcgtttcatttcagacgcgctgacagcttgtcctctgccaactaacgtatcagtagttgtcccgcctacaggtccaaggttaacacctgcagaagcgtatgcccagcgtacgaatgatgagcagtcaaaaatacggttgttgatatcagattggctgcgtccgccgccaaacttgtacggagattgtcctacaatgcttgaaccaacgctgatcgcgccttcaattccgccagagttgctgataacagtgccgcctgaattgctgtttgagccgctgctcttcttagaagatgagccgtttgacgaactgtttgatgaaccgttagaagaattgtctgaagaatcatcagatgagcttgcttttgctgattcagttgtcgccgtttgactgtcatctgtttgtgtttcatcagatgctttttgtgcttcttcctgctttttgatcaaagcagccgctgcttcttgttcttttttgatgcgtgcttgttcagcttcagtatttgctttttgatttgcaagttcagacgcctctgattttaattcagaaatcgctttagccgttttcttttggcttgcttttgcttcgtcgaaaagcttgtctttttcattaagctgtttatcaaggtctttttgcattgtttctaatttagccaatgcagcttgaacttctttcagcttgtcattcaaatccgcttcagaatcttcgagcttcgctttatcctgctcttgctgtttgattaaatctttgtctgcgtccacaatagatgaaaccgcagtcgcacgagagataaagtcaccaaagcttgttgatcctaaaagaacatctatgtatccttgagatccgccgctttcctgtaaagaacgaacgcgttttttcaggatttcattgcgtttttcgatgcgtgcttcagtttctttaatctcttttttcagttttttgatttcttcttttgttttatcattttcttcttttttatcttcgatcttgttgcttgtatcaagcgccttagcgttaatgtctttcagttctttttcaatctttgattgattttcctgaagctcagttaattctttttccttcgcttcaatgctggaagcaacctcagattgcttgctttcgattttttgtttcttttcatctaatgtttccgccgatgcagttttacttgtaaatgggatcaaaaaactgcttgtcccgatgacggaagccaaaccaagtgtaattaaactctttctcactttttatatcctcccttttactgtgaacctgtcctcatttggaatcgtattttgaacatcaagtttcgttcctcatactctacgaggaatgatggttgtttatggttaattattctgtgcatctcttattctggttgtatagcgtttatttcacatcatatgtaaaaaacactaattccttatgtacgagaatcattataccatcaagtttcgacaaattagcgataaattttattacatttatgtttcaaacagatgtcaagtcacacatcatttgtcatttttcttaagcgtgtaaaaaaactgtcgatattattttctcaatataatctatcaaacaaaaaaagagtcgattaaataaatcgactctttaaaatttactattctagaatatcatcaatatatttcatatatttcgtcaaagttgccggagagatgccgaatcgggccgctgtgtcttttttcgtgtcttgcttgccatgggcttctttccaaatataacagatggctgctgcccagcctttctcattcttcaacggagcggctgcacgaatttgctggatgacatggaaaacccagcagctcatgacttctgttttcatctcttctttttcagcttgctctaataatttgaccgtttgataggcgaaaagtgcatcctctgaaacgtcagcagccgcagaatctccatttagaagcagctttacaaaatgattttcaaaaggagcggtaattctctttgatcttatcaccgcttcaagatgctccgtttctccctttgtgctgctgatataataggctgcgagacgctgttccacagatgaaggaagagcttccctccgctcaatccaaggcgccgggcggtcttcgccgggatattgcgactcgacttttctccagatcgtctcggcaaagtcggtatgtcccgtaaaataagcagagcaggaaagccagtaaaagaaggtgtcgtcaccttcaaagccggttttatataatgatttgagccatttatatccgatctcgtagcggccgacaagcgccaatgtagcacccaatttataacgctgctccaatagcatcggatagacattggagagctgatcactcaattccgccactttttcgtcttctctttcataatagtagaaaacgagaaggttgcataaggcgtgaagatttccttcattatgagaaagcacttcataagcggtttgcttcgcttttacaacgtttcctgaatagaaataggcaagcgcgagattgttgtatgctgaccaaagctccggatattcagctgtgatttcctcaagcgccgcaaccgcttcagcaagctggccgctttccagcaatgactttgcccgatcctgtttcaccagcagttcatcctggtcatacaacgaatcctcaatgccgtcgtctcctaaatcgagcaaatcaagcagactatcgttttcttcggcgaattcaccatccgggtccgcatcagaataagcggccgcttctttataagcttcctggaagagccccagatgggcaaagttattcgctttaaagtaatggcactccggcatttcggcctccagatttgccatgatatagtcaagaagatcgttcgactcttgatactggcccatttccgaataaatgaccgcaagctgtgaaagcatctctgaatcctccggctccaaatgaaccgcgcgctgaatcagtttgcttgcccgttttagattgcgctctttatacgctttcaagcctttatgaaaaaaatattgtccatcttgaagcagctggacaatttgtgcgtgatttttatgttcagaagtgtgttttcccacaactaccctccgttttatacaatattaccgtcagtagtataccataaatcgtaagcccctcaatagttcaaaaggaaggattgggaaaatccctcctcttttttattggctgattcgaccaaaatttacccggctttgttttctaagtccgcattcattttcagctgctgttcagcaaaatcccggtaaaggccatgggaagccattaactcatggtgtgttccacgaccggtaatttctcctttttcaacaaacaaaagctggtccgcatctacaacggtagataggcggtgagcgataacaatcgttgtgcggccctccatcagcacctccagcgcctgctgaactgatttttcagattggctgtcgagacttgaggtagcttcatcgagcataagaatgcttgggttacggagaagcgctctcgcaatcgcgattctttgcctttgtccgcctgacagcataatgccgcgttcgcccacttctgtatcaaactgattcggcagctcctttataaaattgagcgcatatgccatctccgcggctttttcgatctcagcatccgtcacatctcgttctaacccgtagcaaatattttctctgattgtcccggacattaacgggctttcctgcgatacatacccgatgtgctcccgccacgattcaagcgagtaagtatcgaccggctcgtcccccagccgaatggtccctgcagtcggagtataaaaacgttcaagcagcttaaacagcgtcgttttccccccgccgctcggaccgacaatcgctgtgactttacctgcttcaatgacggcgctgacctcttttaagatcagctgatcaggcttatatccaaaagacacgcgatcaagctggataggcagatgtgcattttcaatttgttttcctgtcactgtatcttcctcttcctctgccaaaatctcaatcattcgttctgttgcaccgattgatttttgcagctgtgtgaaaaacgttgtaatctggcccatcggcataataatttgaaacaaatataaaataaaagccacgagcgctccggccgtgagttcgcctgaagatacctgcatgccgccatatccgatcactgcgacaagcgctgccattagcacgagtgagataagcgggccgacaagcgattgaaccttggcttcacgaacgccaagcttaaataatgaggaaatccccatcttcccgcgcccgtattcgacatcctccgcatttgaagctttgacaagtctgatttccgggagaatttgattcagcaggcctgtaaaacgggctgtttcatcttgcgtttcccgtgaaatggagaacattttccgtccaatcggcaccaagataagagcggccagcggaacaaccactaacacaagcagtgtcagcttccagttcataataaacaagattgtcaatgatccaatgacagaaatgatgcctgtaataaatccgctgatatgggttgtaatcaattctttgaccaccatcgtatcgttcgttacacggctgactgtttctccggaagcatttgtatcgaaataagagacaggaagcttaattaatttcttccataataactcccgcagcccggaaatgattttttgtccattatagttaagcgcataggtggcataagcgcttaaacccgcctgaacgaaaaacacaagcgcgatcaaaccgatttgcgtgcctgacagatttgacatagaaaaaccatcgacaagctgcttcgttaataatggaatgagcaggctgaccagcgtggttactacactgagggcaagcgcaaaggcgagctttccataagaaggattggtccgtcttactaaggcaaaaaagggtttcaatttacttttagatttttgtttcttggttggcatatattttcctcctgtttcagcgttcagaaaggtgaaaagtcatagcaaaaggatgatttttactctttctcaatcatatcaatggagaaagactttttcagtatatttttgccgtgatcaaaataaaaatctcccactcattgtttgaataggagattttttatgttagagcactggcttcttttttctgtaagtcaatgttacatcctgctgccgcaagtcttcaatgatcattttgtaccgatcaacttttgcggtatgttcttcttttatcatctgaagggcagcttttcgtttttcgcttttcgactcaagttcttcttttattttttttacaatcaaccctttttgccctttgatttcctcttttaatgaagactcaaatttctttgtcaggctgagaaagtcgttgatcggttgattgagggtgcccgctttccccttcatttcatcttgggtaagaaacatataggtcgttgatacaatttctgtttcactttctgaaaataaggaagtcactcttcatattcctcctaaggctgaaaatcaaataactgagaaatcatttcttctttttcaaacagcttttcaatactctcgcggatatttttgataaaatctcttttttctgttgtctgtttttttaattcagcaacaattccatcatttgcaggaagcgcacctgtgtggaatgattcatgaacagagattttctccaatttatcgaatgtgtggctgaaaccagctgcaagccggaattgaagatcgaaggcataatgcgaagggttttcttccatatgatgaatagccgtgatgatcgcctgctttttgtctatgaaatcttcatcgatttcctgactgtaaaccttctggtacttagaaatcgcatcttccatatcttcaacgattttcataccgttttgatagattctgacagcggatgagagattgacttgaatcgtttctcccgagccgctcttccctgtaaaataaatatcggagcctttatagctgaagcctttttcctttgacaaggcgttgagcatttgaacgatgctgtggccgtcgatgataagttttagtgcgtcttttgtttctgtgtcgagtgttttcaatgaggacagaattgattttacatagtccactatttcaccaacgtcttttaaagcttgcataaattggccatgctttaaatggtcaatgaaatgttcgtaccgtgattctatgcctcgcatactcgcattaatattcgttaattcttttttgatgactttcttttgcgtttcatcaatataaccgttttcagctaactgatctacgacaggtccgctgtttctcaacaaggtatgaagaaaacctaaaaacgacggcagttcctcttttattcggccatacatttgcttaacatcatcaaaatgctcatataggacacttactttctttaaagcgccgtctgtgtttttcactttttcaatcaggtctatgtctatcccgctggctgcctttataaaaccgttcaagccgtctttttcatagtcatccttatatttttgaaggaatttttgaattgacctcacatcttcgtcaggaaccccatccataatatttcggatgccttttacacttgtatttgtatctgccatcttcacatcaccgaatgtaatgaaatcggccttgccgctgactccatacagcgggtcatcttttgagatgcgttgggtgatgtttgctgttacgcctttgtcttcataatatttttggatttctttttttagcttatctggtgggatatcatttatatcttttaagcgtctaatatgaaatttatgcattagcctatctctcaaattcaaatcagttgctagcaggtggtcaacgcttatttgagctccgttaaccccataaacctcatcaaattctccgtcaattaattgaaccatcacctgattattatttgccagtgagtggcccatagcaaaggtctttaaatcatgagaattctctgtttctcttttggcatttcttacaaactcttttgtcgcttggtactggctgtcatctatccctaaaaagagaccaaagaaattgtatgaccagtcttcgttatcagcactcccctctgaaataatatgaagttgattaacgtgttgtttatcatccttaatataaatagctgtaccatcatatccggactctcttattgatgtatctattttcgaattttttttaataagttcattagatgtgtatatttccagattttttggaagatctcgatgtgtttcttctttgtatattcgacgcacctcgacttcaaaatctgttttagctctctttatttcactttcaatattagaagcaaatttttctttataatcgtactccaagtcaattaaacgcagctttacattttcattttcaaatatattcttattttccattttctctatttctcctttttaacttttaaaaaggtaatagaatcaattatttttcgaacttttttttctgcttcttctttctttaatgaacaaacctctttacccttatagcaagaaaaacgaaaagaatactctattcctaaatattcctcttttttagatttaacataaccaaaaaatctataagaaaaattattcttttcatccacatcatcaaaactgcttttcttttgagcagaatatacaattttatcagatagctctctttcttcgtattttcctttatagctatttctgccgcttacaatgtcaagcattgtatccttgtcattcgcaaaacttttttcttgatgataatctaattgcccgtcatattgaatgttagtttttttattgaaactatcaaatactattgtttcctcattttctcctatacttgaaagatcaggtgcatactccccatcctccggaaacaacatcctaaaccctttcagcttagattcaagcaaataataccccggctcctcttctttcgttgacaccatgtactctctcgttttctcatcttgaaacgccggaacttgcggcaggtcttttggatccatgtcttttggttttacggcttctgttttattgtcatttgtggtgtttttatcattgtcatgcatactgcatcctcctgtcagggcaagtaataagctgaagcaaatatagatgatctttttcattacgaacctccacgggttttgtgagaatagtattctatttttatatcaaaaataattctattgacctgcttaagaaatgattattttatcctttttcatgttacatcatggcggaatttggataaataggaaatgagactcggttttgatctccttttattaactaatcatatataacacctaatataactctaaatacctattacttttttcacaaaacaaaaagagccgtatcatccggctctttactcttctttctcagaatggcgttttttcaatacgtcaagcacatcatccagcggcaaggcttgttctctgagcaggacaagcaggtgatacagcaggtctgccgcttcccatttgagttcctcatgatcccggtttttcgcggcgatgatgacttcggatgcttcttctcctacttttttcaaaatcttatcgacgccttcacggaagaggtacgtggtgtaagctccttcaggcatttccgcttggcgttccgcgatcacccgctccagttcgttcatgatgccgaatcggtccgcggcctgttcttctgtttgttcctttgtaaaacagctgtagctgccagtgtggcatgccgggcctgacggttctacgagtacgagcagcgcgtcttgatcgcagtcataccggatacctttgacggcttgcgtgttccctgaggtttctcctttatgccatagcgcttggcgtgagcggctgtaaaaccatgtttccttcgtttccagcgttttttcgtacgattccttgttcatatacgcaagtgtcagcacttctttgcttgccgcatcctgcacgatagcaggaattaatccgtcctcgttaaaacgcagttcatctgcctgtttcatctcacattcaccccgtactctttcaagtatgatttcacttctttaatcgatgtttctttataatgaaaaattgaggcggccagcgcggcgtcggcttctccttttgtaaaagcctcaagcatatgctgtgcgtttcccgcgcctcccgaagcgataacagggacggggacagcttcggaaacaagctttgtcagcgtgtggtcgaagccttttttctcaccgtcggagtccatgcttgtcagcaatatttctcctgccccgcgtttgacgccctcttttgcccacgcggtgacctcccaatctgttttctttctgccgccgtgcgtgtagaccttatatgtgtcagattctttgtcatacttggcatcaatggcaagaacgatgcattgagaaccgaaaaactcggctccttctgcaatcagctcagggcggagaacagctgccgtgttcaccgacactttgtccgctccggcacgcagtatcgttttcatatcgctgagctgattgatgccgccgccgactgtaaacggaatggcaagcttcgcggcaacctgctccacaacgtcaaccatcgtctttcgtccttcgtgcgaggcggagatatcaaggaaaacaagttcatccgcaccttcccggtcgtacacttcagcgagttcaactgggtcacctgcatccttcaattcgagaaattgaattcctttgacaacgcgtccttctttgacatcaaggcatggaataatccgttttgtgatcatttgcgcttcaccctttcaagcgcctcacacagcgtaaactgattggtatacagcgcttttccgatgatcgctccagagacgccgtccgcctcatagcgggcgagagcttcgagatccgcgacggagctgactccgccggaagcgatcaccgatttccccgtttccttagcaagctcgaccgtgcttttaacattggggcctgacagcattccgtctgtcgcgatgtcagtaaaaataaagacttccgcaccttcattggctagctctttgcccagttcagttgccttaagggttgatgtttccagccatccctctgttgaaacaaaaccgtttctcgcatccagtccgattgcaattttctcgccatattgtttcagcatttttttgacaaacggagggttagaaactgctgagcttcccaggatcacccgatcgactcctgctgataaatattcatagacgtcattttcggaacggatcccgccaccgatttcgactttcaggttcagcttttgcgtaatctcaatcacatggcggtcattcactcttttcccttctttggccccgtcgagatcaacgagatggatccattcggcaccctctttcgcaaataactcagccatgtcgtacggtgaatcgccatatatcgtttccttattgtaatccccttgaacaaggcggacacatttgccgtttctcatatcaattgccggatataatgtaaaagcactcattttttcaccttctgttctgctgccattttcgtaaattgagttaaaatagacattccaaccgtgctgcttttttccggatgaaattgggcgccgaagacgtttctttttccgactacagcaggcactcgtacaccataatcggcgcttgccagaagcgcgttctcctccatcccgtcaatgtaataggaatgaacgaagtaagcgtagccttgttctgttttagtcagcagcggagattcattatgaaaagaaagacgattccagcccatatgcggaaccttcagcttgtttcctttttcatcttctgctttcagcctgactgcttttccttttaacagcccgagtcctgaagcggtgccgttttcttcgctttcttcaaataaaagctgcatgccgaggcagatccctagaagcagtcttccctctgagaccatatcgtgaatcaattgatcaagcttcgtgtagcgcaaattgtccatcgcgtctccaaatgaaccgactcccggcaaaatgaaggcatcagcttccttcagctcctccggcttttcagaaacaaaatgcggcacgccgacacgttcaagcgcctttgagacactgtataaattccccattccgtaatctatcacgccgatcatttacagcatccctttcgttgacggtattcctttaactcgcggatcgatcgttgtcgcttcatcaagcgcacgtcccagcgctttaaaaacggcttcaatcatgtggtgggtatttgtgccataatgaacgatgacgtgcaggttcattcgagcttcgagcgcaagcttccacaaaaattcatgtacaagctccgtatcgaaagttccgactttagcagccgggaaatcagcgcgcatttctaagtgcggccggttgcttaaatcaatcacaacttgagcaagtgcctcatccatcggcacaaacgccgatccgtagcgtttgattccttttttatcgcccaacgcttcgagcagcgcctgccctaagcagatgccgatatcttcagtcgtgtggtgatcatctatatcaacatcgccttttgcgttaatggaaagatcaaattggccgtgtttcgtgaataaatccaacatatgtgtcataaacggcacatctgttttaatatccgcttgtcctccgccgtctattgtaaatgccagctcaatatctgtttcgtttgttttcctgacgcgttccgcttttctcatttagaaatcctccgttctctcgcttcaattgatctggcatgggcttctaacccttccagtctggcaaaagccgcgatgctttcggcatgttcttcaaaggctgattgactgtaagaaataatgctcgatttcttttgaaaatcagttacgtttaatggacttgaaaatctggctgttccgtttgtcggaagcacatggttcggtccggcaaaataatcaccgacaggctcagggctgtatctgcctaagaaaattgcacccgcatgtttgatactgccaagcaaagcttccggagactgtgttatgatttctaaatgctctggcgcgagtatattgacagtctcaatcgcttccaccattgtttccgccacatatatacaaccgtaatctctcactgaagcttccgctatttctctacgcggcaaggttttcagctgcttactcacctcggctgaaaccgccttggccagcgccatggaatctgtgacaaacacacatgagctgagcttatcgtgttccgcctgtgacagcagatcggctgcaatttcatgcggtactgctgtttcatcagccagcacgacgatttcactaggtccggcaatcatatcgatatcgacatcgccgaacacttctcgtttggcaagcgcgacataaatgttgcccggacccgtgattttatccaccgactcaatggtttctgttccgtatgctaacgccgcaatcgcctgagcgccgcccattttgtaaatgtcttttatgcccagctcggcagcagcaaccaaaactccaggagacagcagaccgtcttttcccggaggcgtgacaagaacgattctttcaacgcccgctacgagcgccggaatcacattcatcaaaacagatgaaggatatgcggccgttccccccggcacatatacaccggcggaatccagcgccgtcattttctgccccagcattgtgccgtcctttctgtgataaaaccaggaggattgcagctgtctttcgtgatattccctaatattttcgattgcctgcctaatcacctgaagaagacgtgaatccagtgaggtgtatgcctcctcaaattcttcttttgtgaccagcgggctgtctatttcgatgccgtcaaatttcgccgtgtagctgcgaaccgcctgatcaccgtttgctttaacatcttcaataatggaccggaccgtctttctttgctcttccgttccggcatcgatggaacgcttgagagaaagccgttccgctccgctgatggttttgatcttcattttgccgtctctccttccacaacgagagataggcgggatgccatttcgtcaatcacatcgtctttcatgcgatagcttaccgggttgacaataaagcgagaggtaatgtcacaaatgtgctccgtttcaacaagcccattttctttcagcgtctgtcctgtggaaacaatgtccactatccgatctgcaagcccaatgagcggagccagttcaattgaaccgttgagcttaatgatctcaacttgttctccctgctctctgaaataactggaagccacattcggatactttgtcgcgattcttggcgctacgccgctccagtctgtattcggaagtccggcgacagctaagtggcatttgctgatttttaaatccagtacctcatacacatcgcgttcctcctccagcatgacatccttgcccgcaattccgacgtctgccacgccatgctccacatacgtggttacgtccatcggcttcgctaatatgaaacggagattttcctccggcacatcgatgatcagttttctcgaatcttcaaactcctcagggagcctgtagcctgcctgcctcagcagccctgccgcttcttcaaatatccggccctttggcatcgccattgtgagtaacttacccattttgctcttcctttctggcaccgataaaataagtgacgtttgcaaaagattttgtcatctggtcgatattttctattcccgataaatcttgaagaaccactttgttccctttcatgcgttcttcattcgcataagcgatggcttgcgcccgctgctctttgctgaaaataacagcgtctatatcacaaggttcttctttcatatgaagggcttcaatcagccggtcgatccgaagcccgaagcctgttgccggtgcaggtgaatcaaaatggcccagcagcttgttgtaacggccgccgcttccaatgacaaaaccgacattctcggcgtacacttcaaataaaatccctgtgtaatagctcatgtggctgaccatattcagatccaggcggacattttccgtacatccgtaatcctcaagaatgtcccacagcgccttcagctcatcaaccacgctttttccttgcgcagaatcgacgatttcctcggcacgtccgcatacttctataccgccccgcagttcaaggagctcaagcagcctgcttttatcaatggaggaaagcgggagagacttgacatgctctctgtagccgacgtagttcttttcatataagaacctccgcagcacatcagctcgttcaacgttcccgagcacctcaacaaacaaagcatccgcaatgccagcatggccaatggcaattttaaaggatgccagcccagcgtttttcaatgccccgacgactaaagcaatgacctccgcatccgcactcgtcgtgccgtcaccgattaactccactccgacctgctcaaactcagccggacgtccgccttcacgctcctgagccctgaatacatttgccgcatagccgactcttagcggatgaccgtgtttcagaagcttcgatgccgccacccttgcaatcggccccgtcatatccgggcgaagcaccaatgtcttgccgtcctgatcaagtagcttaaacagctgttgctcttcaattgctgactggacgccaaccgtatcgtaaaactccagtgtcggcgtttccataaattgatatccccatttatcaatcaaatcggttaacgatcgtctcaccttttttttcgtttcgtataaaccgggcagtgtatctctcatgccgtgcggtttttcaaacataaacatcaacccgagcacctccgctgttatcttatgaaggaaaattccgaatcctttagttcgctaatatgataatatgttagcagatgaaagaatgaaaatcaacgcttaacttcagtaaggatatttttagttcaaatatccttctcctcattatgaaaaaatcatgaataatgtattaaaggtacgtaatatctcaaattctttatgtttggcatgctataatacaaatcaaatagagaacaaggagataaagatgaaaacactgcgaactctatgtgtcctgatgattctttcaggcgttatttttttcggacttaaaatagatgcaaaagatatagatattccttttttgaacagccttaaaaaagtggtttctgatagcgatacagactcagctgcgaatagcaaaaaggagctgaagggaagcgcaaaaccgctggatgtcatcctttacaatcaaatggacgcaccccggctctataacggctgtgaagtaacaagccttgcaatggtgctgaattacgcgggatacgacgtgacaaaaaacaccctggcaaatcaggttgccacagtgcctttgacatacagcagcggattaaagggtgatccgaatgacggatttgtcggggatatggcgaatggccctggtctcggtgtctaccatcgaccgatctatcagctggcgaaaacctatgcgggagacaaagtgtttgacctgactggaaaaagcatttctgctgtttatgaacagcttgaaaaaggcaatccagtttgggttattacgacagccaactttacgccagttgacaacatgcagacatggaaaacgccaaacggaacgatagagattacgtacagcgaacacagcgtcgccgttacgggatatgatgataaatatgtgtatctcaatgatccgtatggctataaaaacagaaaaaccgatagaacaagctttgaaaaagcgtggaaacaaatgggcagccaggccgtggttattcaaaagtaaacacctgaagcctcactatgctctatcctgagcaaatacgacaatattcatgctttttgtttcaatcggtaagattgattcattttccatttatcatccagaattatctttactttcaggctatctgtttttatgattaaagcagattcagccttgccccgatctatgcgagagaagccggtgcaagtcgctgacgcttctcttgcaaaaaatgaaagacatccggggaggatttatcattgaaaaaattcgtgtctatcctatttatgttcggtttggttatggggttcagccagtttcagtcatcaaccgcttttgcagcagacaaagtggtgcacgaaacaattatcgtaccaaaaaatacaacatatgactggaaaggacagcggtttgtggcagggaaagaattaggcgacggaagccagtcagaaaaccaagaccctgtttttcgtgtggaggatggtgcaaccctgaaaaatgtggtgcttggcgcccctgccgctgatggcgtacacacttatggaaacgttaacattcagaatgtgaaatgggaagatgttggtgaggatgcgttaacggtgaagaaggaaggaaaagtgacgatcgacggcggttctgcacaaaaagcgtcagataagatattccaaatcaataaagccagtacattcacagtgaaaaacttcacggcagacaatggcggaaagttcataagacagcttggcggttcaaccttccacgttgatgtgatcatcgataagtgcaccatcacaaacatgaaggaagcgatattccggacggacagcaaaacaagcacggtcagaatgacaaatacacgctactctaatgtcggtcaaaaatggattggtgttcagcatatttacgaaaacaacaacactcaattttaaccaaaaaagtccgctgatgttattcagcggactttttcaatctttcttgcatttcttccttcgtatagatgatcctcatcggatttccgccgacaaatgcgccggcaggcacgtctttatggacaagtgttccggcggacacaactgcgccatctcctattttcaccccgggcagaatggtcgtgttggcaccaatcatcacttcgtctccgatcagaactgtgccgatccggtattcgtgaatcaaatactcatgggccagaatggtcgtattgtacccgatgattgtatttgttccgactgagatcttttccggaaacatgatatctggcatcaccatgagggcaaaggatgtctgatttccaaccttcatccgcagaaatgtacggtacagccagtttttcatccctataaacggcgtatatctcgcaatttgaatgacaatgaaatttttgacgacctttaaaaaaggtaccgtttgatagacatgccacagtgagttggcccccgagaccggatgacgatctgtttttctcacagattacttcactccaacgatttgtaatagatcactcattttctcaagcataaaatccggctcatgcttcgccagcatttccggccctttaatcgtccatgcgactcctgccgtttttgtaccggcgtttttgcctgccagcacatcgtggtaattatctccgaccataatggcttcctcgggcttgcttcctaactgtttcagcgctaacagcacaggctcgggatcaggctttgcattcgtcacatcatcaagggtgacaactgtttcaaagaattcgccgattcccgtgagcttgaggcccatattgacagtatctcttaattttgttgtcacaattcctaatgtaaagccggctttttttaatgcatccagggtctcatataccgtttcatattcagtcacgagtgaatcatgcatgtcatgattgtacgctctgtacatagcgatcatatcctcgcatttatcagggtccatcgaagagaacgtatcaaaaagagacggcccgataaatgcaaggacatcttctcgtttatacttgctcggataataatgctccagtgtatgcaaaaaggacgcgataattaattcattcgtattaataagcgttccgtctaaatcaaacagaatcgtcgttacttgtttgtcactcatattgcttcctttccaaccgctgagggtttccattttttccacgtgtgcgcaatagccattgtcagcagaactgctgtggtgacacgaatcaaaagaagcggccagaccggtatgccaagcggaataaagacaagtgtatcttccacgaccgcgtggcaggcaacgagaaatataaatgccaatgtcatgtcccgcttgctcacgccgtcatcctcgacagctttgatcatgacacccgctccgtaggccagaccaatcgtcagtcccgccaccattgtcatagacgtatttttattcatgccaagcagctgcgtaaacggagacagccacctggagaaccgatgcagccagcctaaatctcttaaaaactggatgatgatcatcagaggtatgacaattgccgccagctgcaaaacaccaagtccggctttcgttaaggcttctgtcagcattgccagccagctgtctggcgccgcgctcttcgcagcgataaaaccgtactgcgccgtttcctttccgccatgccaaatgaggttgatgacgatggctgacacagcggccaaaccgatgcgcacggccaatatgacgccaattctgataccaacctttgcggcaactgtcgattcgataatcaagttatgacagaaagaaagcataacagctaaaataaagacttctttcacagataaatccaatgttaaaatcccggcaattcccgcatacagattcagcatatttcccaatacaagcggaatggccgcttcaccagaaagcccgaagagacccattaccggtgtgatcagccgtacaagccaatccatgacaggggtatgctgaatcaaagtgaccaatagcgttaccgggaaaatcactttacccagcgtccatgttgtttgaaaacctgctgcaagaccggcaagaaggatcttcttcatccctcatccccctttgttgacgtctactccgcgtaccgctccttcgaatatcccttgacgcgtctgaagatgatggctgccacagccaaaacaatcaatacgattgaaatcacctgagcgatgcgaagtgaatcagtaagcattaagctgtcagtccgcattccttcaataaagtatcttccgattgaataccaaatgatatagatcaagaacatctcgcctctacgcaaattcgctctgcgaagcagcagtaaaacaatgacgccgacaaaactccatagtgattcatataaaaaagtaggatgataatattgcccattgatatacatttgattgataataaattcaggcaggtgcaggttttctaaaaaggctctgctgacagcctcgccgtgcgcttcctgattcatgaagttcccccagcgcccgatcgcttggccgagcaaaatgctgggcgcggcaatatccgcaagcttccagaacgaaaggtttttcactctcgaaaacacataacccgttaaaatggcgccgattaatccgccatgaatggcaatgccgcccttccaaatcttaatgatttctcccggatgtaccgcataatagtcccattcaaaggcaacgtaataaattcgtgcgcaaataatcgcaattggaatggcaaacaggacaagatcaataaacgtatctttctgcagcccccgtttttcactttccctcatcgcaatccacagcccgagcaaagcaccgagaccgataatgattccgtaccaatggacagctaacggccccagctgaaatgctatcggattgagtggttctatcgcttcattcatttaacgccaactcctattcttcttgttcaccgtcttcaatgacgtccgccagcttgttggtaaattgttcagcggcattcagccccatccgcttcaatctgaagttcattgctgccacttcgataatgactgcaagatttcggcctgggcggacgggaatcgtcagttttgtaatttctgtatcaatgattttcatggtctcttcctcaagtccgagccggtcgtattgcttgccctgctcccagagttcaagattcatgacaatcgtgattcgtttattgcttctgaccgcgccagcgccaaatagcgtcatcacattgataatgccaaggcccctgatctcaagaaggtgctcaattaattccggagcgtttccgacaagagtatcctgatcctcctgccgaatttcaacgcaatcatcggcgacaaggcgatgccctcttttcacaagctccagcgctgtttcgctttttccgacgccgctctttcctgtgatcagcacgccgacaccatatatatcgacaagaacgccatgaattgctgtggtaggcgccagcctgctctcaaggaagttggttaaacggcttgacagtcttgtcgttttcagcggcgatctgaggacaggcaccccatttttctcggaggcgtcaatcagctcctgcgggatgggcatatctctagaaagaataatagctggtgttacatcagtgcacagagaatccattcgctgttttttctcctcttcaggaagctgttcaaagaaagaaagctctgtttttccgagaagctggacgcgctctctcgggtaatatgtaaaatatccggcaatttcaatgcctggtcttgataggtcactcattgtaatcgggcggttaattccttcttctccgctgattaattccaaattgaactgttccattacgtcttttgtgcgaacctttgccacgatatgttcctcctgttccgggctgccccgagcttgctcacaatactttcattttatcactttcaggcttgaacctaaaacagattttataaaaggggggaaatcacctcagctggtctagatcactagtctgaaaaagagtaaaataaaggtattcaaattccagaaaggcggatcatctatggcagagagtcttcttatcaaagacattgcgatcgtgacagaaaatgaagtaatcaaaaacggctatgtcggaatcaatgacggaaaaatcagcacagtctcaacagaacggcccaaggagtcatattcaaaagagattcaagcacctgcgaattccgttttgcttcccggcatgattgacattcatatccacggcggctatggcgcagatacgatggatgcaagcttttctgcgctcgacatcatgtcgtcaagacttcccgaagaaggcacgacgagctttttagccacaacgattacccaagagcatgggaacatttctcaagctttggtgaacgcaagagagtggaaagcggctgaagagtcctctttattaggtgcagaactgctcggcattcatttagagggcccctttgtttcgcctaaaagagccggagcgcagccaaaggagtggattaggccttcggatgttgcgcttttcaaaaagtggcagcaggaggcgggcggactgatcaaaattgttacacttgcgccggaggaggatcagcattttgaactgatccgccatttgaaagacgaatcgattatcgcgtccatggggcacacggatgccgattccgcattgctgtcggatgccgcaaaagcaggggcgagccatatgactcatctgtacaacgcgatgagcccgtttcatcaccgagagcccggagtgatcggaacggcgctggcccatgatgggtttgtgacagagcttatcgccgatggcattcactcccatcctttagcggcaaagcttgcttttttggcgaaaggcagcagcaagctcattttaattaccgattccatgagggcaaaaggactgaaagacggcgtatatgagtttggcggccaaagtgtgacggtaagaggacgaacagctcttctttcagacggaacccttgccggttcgatcctcaaaatgaacgaaggcgcacggcatatgcgtgagtttacaaattgctcttggacggatatagctaatataacttctgcaaacgcggccaaacagctgggcatctttgaccgaaaaggcagtgtgactgtgggaaaagatgcagatttggtgattgtcagcagtgattgcgaggtgattctcaccatttgccgcggaaacattgcatttatatccaaggaggctgaccagatatgaaagtaatggaatgtcaaacgtatgaagagctaagccaaaaagcagccagaataacggcagatacaatcaaagaaaaacctgatgccgttctcgggttagcgacgggcggcacaccggaaggcacgtatcgcgagctgatccgcctgcaccaaactgagaatctctcatttcaaaacgtcactacagttaatttggatgagtacgccagactttcaagcaatgacccgaacagctatcacttctatatgaatgaccgtttatttcagcatatcgacagcaagcctagccggcattttattccgaatggaaatgcagacgatttggaagccgaatgcagacggtttgaacagctagtcgagtccctcggcggcactgacattcagcttctcggcatcggccgaaacggacacatcggctttaacgaaccgggaacgtctttcaagtcgcgaactcatgttgtgacattaaatgagcaaacccgccaagcgaatgccagatattttccttccatagacagcgtgccgaaaaaagcactgacaatgggaattcaaacgatactctcaagcaagcgcattctgctgctcatttctggaaaaagcaaagcggaagctgttcgtaagctgttagaaggaaacatcagcgaagattttcccgcatctgctttgcacctgcattccgatgttacggttttgattgatcgtgaagccgcgtcattaagaccttgaaaggaacatgctgacttatgaatatcaataaacaatcgcctattccgatttactatcagattatggagcaattaaaaacccaaattaagaacggagagctgcagccggatatgcctcttccttctgagcgcgaatatgccgaacaattcgggatcagccggatgacagttcgccaggcgctttctaatttagttaatgaaggcttgctctatcgcctgaaagggcggggcacctttgtcagaaagccaaaaatggaacaagcacttcaagggctgacaagctttaccgaggatatgaaaagccgcgggatgacaccgggcagcaggctcattgattatcagcttattgattcaactgaggagctcgcggctatattaggctgcgggcacccctcctctatccataaaatcactcgggtgcggctggcaaatgatattccgatggcgattgagtcctcacatattccgtttgagcttgcgggtgaattgaacgaatcacattttcagtcgtcgatctatgatcatattgaaaggtacaacagcataccgatttcccgtgcaaaacaggagcttgagccaagcgctgccaccacggaagaagcgaacattcttggtattcaaaagggagcgccagtcctattaattaaacgaacaacatatctgcagaacggaactgcttttgagcatgcaaaatccgtatacagaggcgaccgttatacatttgtccactatatggatcgtctttcataaaaaaagcctccaaccctttttaaggattggagacatggcgaaaatcaaactggtctggtgccggacgatatgtttcttttttcgtcttgaacttccagatcggtgatttcgttttgccgttaaaactgtcttccactataatgtaccaataataaacagactgcggttcaaggtgatcccagcggaattcagctgtatccccgctcttcacttgctcccgttttccgagctcttcattggtatatacattacattcaaaataatcggtttccacctttttgattcttggcttcaaatcaagcgaaagggaaaattcatccttgttgccataggtatccgtatcatagtaattcttatcctttacatacggagaatacgtcgatacgtgcaccatgtcattggcctggtcaaattgaagcaaacgcaaatacccttgaccgccttctggcccgccctgataatcggccagcatttgatgcacaagacgatccggcttcccatcaccatcatcatccagctcatctgtttttctcatcgcactatgataatgcccgctcaataccatcacgacattcgggttcggctttacgatttctttgaatattttctctccgatcgggcttctgtttccgctgaccagcaaatactcatgaaaagctaaaatggccatccggtcagggtgtttcttcagcacctgattcatccacgcgatgtcttcatccgtaatgccccatcccatgtacagcatgatataatcattgccgttgctagaaatcaggtcataatgtccgcggttatttttataggaaccgccataatgcaattttttatcaaaacgatcgctgccaaaatatttgccaaacgccctgtaggagccgtccttatgtccgacatcgtgattgccggccagcacgccgtaaggaattccgctcttatccagaacggacattgaccgatcagcgtttttccactgtctgatatcggcggaatcatctacaatatcacccgtgtggaacacatatttgatattgagctgcttttgattatcttttatccattcggtctgtttatcaaaaatatgcggatagctttcggcgtaatactgtgtatcagacatccagacaaatgtgtacatatccttcgcaggaggaatttcatcctgtacaatcacattcattttcgactcccgtacaaaatcggcggcaatcacagacgctttcagcgtaaacggtttgtcatccttcgcgacgaagctgtcaacaggctgccattcgtttgtccgataattccaagcatacatcgtcacctttctccccggcaaagaactgcccttccagactgcttctgccagatcattctcatcaattgatggatcaaccgtcacttcaaagcgatgataagggaaaagctctttgttttctgtcgatactgtttttccatcagcagctgatacccgctccaattctttattcgtaaatggggtctccctttccggcacaaagcttttcggcggttcagtcagtgacgcgtgcttaaatattttcacatgattgcgcgctgtatattgaaatcccctataaaaaccaacatccatggcgtcattcgtcggatctttcacccgtacagaaagcttggccttatgcgtgtcggcttcgctgtctataacctccggctggtccggatgctctcgttcggttttaaatatcctctcaatcactgttttattgcccgcgagatccgttgctgtcacttttagagaatgttttcccggcaaaaggtcagaagatgatgtatgatatgggagtgtaatgctttctccatctaaagacgcttccgcttcctcaattttgctccatttatcatacatatccgcctgcaggataaggtttcctttatacgtttgcccctcggtgatattcggctcaatgtgaggtcctgaattatctacccgtacaaccaggctgacattttccttgccgtcgcttgcttgaatatggtgagcgccttcagaaagctttgatgtatcccactccagcagctgtgatgtaaatagtccgtcaggcagattgaactgaaattgccagcttttattcgagcgctgattatcgccaataaagagttccttctcaggagacaccctctgatctctgatcaccgttccatccgataacaccaatcgggcgtttttgactaagaagtcatcacggttttcagcagtatcaaacggagacaccttcgaacctgaacgtatcgtaatacgctgcagctgcttccctttccgaagcagtgtctctggcaatggaacagaataggtgcggtatttatttgttgtatcatcgaacaccttcagcactttgccttccatcgttaccgcgtttttaaaataaaggttcgttttcctcgtatcgaatgcaaaatatacttctttttccatcgcgggctctgtcacttgttttttcccgtcaatccacagcttaatgctgtcagctcgcccttctgtcgtggctttgagaaattgagttcccgacagcgtgtctctgttttcaatattcatccgcagaccgtgcgccttgcttgtttgtttaatatcaatcattttgaccggcgttctcgcttcattgatcccgtccccggccgccacataatactctagctgatccttcccgatcaattcaggcgaatacacaatataatggaagagattatcgttgcggtctttttcagcaagaattcgcttaaacggtttgttctcatccgtccggtagtaaaaggccgctgttttcactaggcttcggtcccgtatgtcagcccgcagctcaatgctttcagcagggcggacaggcttgcggtcagtcaaatcctcaatgaccggcttttctttatcgagcttgattttccgtttctgctcgggcacctgtgcctgtaatacggttccgggagacggattcttttctccgattgaaatgttcagaagttctgcggttccgttcaacggatacttataaagcactgatgacagccggcgcagcgcatgtttccgataatgcgcaaccgaaatgtcctttcctgtattcgttgatatcacaacggcccgcggcctcgtattggccataccctctgtctcgtctatcaccgcgagattttttccttccgttaattgtgtctggtaatatcgattgaaatcctccgccgtcaattctggatgcccggcaggcttcagccagacgacaaacgtttcgccggatggtatcaagatcctttcatcaggtctccaaatcagatcggagtcaggcccttcttttgggtagcggtaacggatatggtagtctttaaaatcaatcgttctgtcagtcgtattaaaaatctcaataaattcataaccgtctgcgcgtcctatattcttcgtatcaaccgccagttctgtgatcagaagctccggaatatgggcaaggtcagcctggtatccttcaagcttcagtttcttcgtctccgactccacccgctgcttcccattcgacatcacaatgtaatactcaagctcgctgttccaaatcaaacgtttcggaatttgtgccaaaaacttgcggaccgctccgggggtcgggtccatcggcaccattttgtagcccagctcattactttgtttataaaaaagaaaggcggaaaatgcttgatacgaattatcgcgaacttgagcctcaatcattagattgtttctcatttcagctttcacatcaatttgaggaggattttcaagcaagggtatgtaatgaggcgtttgaaatagttcctgctgtacaacacgaaaagctttcgattcatgatggccgccaaacaaaacggaaagaaaagacagtaatatagaagcaataaccgtgtatttcctcatcaaagcacctcccttttcatgtattttgcgtctgaacagggaagcttatgagttcatttttgtgcataaagaacaaaaaaacgtctgtctcttgaaaattccactattacccagtaaactaaggatagttaaccagttaacaattaaatcagagaggcaaattgatggacaacagcattcatgatgaattatttcaagctatacaacaattcgcattaaaaagggataaacgcgtctggcaaaaggtgcagataccatccattggcatatcctcacaacatcacgatcacctcaaaaaagactggactttgacccagcttcacattgtttcctgcatacataccagccaaaatgtgaacaacagcttcttagcatcccgtttacacatctcaaaagccgctgtttcaaaagcggttcatgctttgttgaaacacaatatcattacagtgacaaaaaagcctggcaacaaaaaagaaattttttatacgctaactgatcgcggcagaaaattggcggcattacatgaacagcttcatgagaaagcaaaggagcaatataaacagcttttcaatgaattttcaattgatgatttaaaaacagtgactgcgtttttcaacttgtggatcaaatatatgtaaaaagagtctcacccgcatgggagagacctttggaattctattatgccccgtcaaacgcaacgagaagtgaaacaggcccgcgtgtatacagaccggactcagcataacaaaaatcttcctctaatctgatattccgcatcttatccagcacaatattagctacaatttcgatttcgtttttggcaaaagctgctcctacacagttatgaatgccggatccgaaagcgagatgccgggcggcgccgctaaaagcgctcttgatgccaatatcttcccgatgaatattaaacacgtcaggctgttcaaatgcttcagggtcccggttagccgcaccgatcatacaaaaaacaatcgtatcttttttgatttccataccgccgaccactgtatcttgggacagctgccgcggaatcagctgaaccggcggtttataacgcaatgtctccgcaatggctctcggaactaacgaacggtcagccaaaacatcattcatctgctcaggattgttgagcaaatggtagatcatcagtgccagcgtcttatcagccggttccgttgcggctaacagcacattaagaatcagtgcgagtatatccttgtccgacatcgccatgccttcatattcagaagtacataggatggaaattaaatctgatcccggattgacgcgacgttcttcaatgaccggcatcaagtattgggaaagctgttcgctgcaccataacgaatgtgcccgcgcttcaggagattgagagatactcgtgataaaatcggcaactccgctgtgccactcagagattttttcatggtctcttttatccagcccgagcatgtccatcgtgacgcacaccgcaaacgtctttccaaaatcattgacgagatcaattttccctctttcaagataaggcgctaacaagttttctgcattttgtttaatcaatggagacagatgatccagtgcgtcaccgatgaagcttctcactacaattcttcttttggcagagtgttcttttccatgcatttgggccagcacagggcctcgcatgactggttcggcacgctcaacaagtgatttcgtcgtgaaaatatccggatgctgaaggatatagcggacatcatgatagcggctgataaaataactgtctatcgactcttcataatgaaccggatcttcctcccgcagttgtgaaaaataagcatatggattgttttgaaattgatcagaaagcacactaaacaatttaatcgattggctcatgttttactccccctatcatccttcagatgtgatccgtttctcagaaagcatctgcgccatttcctgtacaatgagatacccttgattcggccgcatacaaatagaaaattcatggttactgatcttctcaccgagcttccacggacgatgataagcaaggagcgtctcttccacctctaaaatatccggagctccgataaaaaacggcagctcagctatgacatattccacagccaaattcagcatatcctcactgacttcttccatcatcaaactgacgccccgtgcacgcccgattatcgcttcacgagacatgtccaaacaagcatgtcgaaaatgaggctgctcaaaaaaagcatgttcaacttcttgtctcaacagctggtaggctttgttatccataaaatcagaaaatgtatgaatcgccttcggatccccgccatgagccacaagggctctttctgcaaatctcctgtttcgtgatacctctttccttacttttcgttcagcctttcctctcggagttccaagcgcttctagaagattagccgcctcatgccctgcaagtaaaactgaaacgcttttaaattgagctttcgcccatccaattaatctgtaaatataatcctctgaaaacctgctgttaaatgggctgatccccaccaaaacatgcctgcgccgttcaaatatttctctgcagttttctgttaatgcctcagcaataaaatgcacagaccttctttccgttaccattccggtcatctcattcacccctaaaacttatcccgctttaagtcatcaccctcaaatacaagatggaatagctagatcaactgaacaagacgaatggcaggcatcacttaaagtttccaaatgttttttaagattttaataatcattttcaatacccatatcatgataaatgtttactagtaaacattagtcattttatcccttttccttccaaacgtcaatatgatctgtgcccaaatatttgaaaataaatgtaaacatcacattttccacacactttttacacgcatattcagcatgacatatcaacaaatagtctaaacaccaacaattgacaatgaaaacaagaaaagataaaataaaattgttcaccagtaaactatttgttttattgtttcatcgtaaactattattactaagaaagaaggtagtctatgtctgatttgacaaaacagatgatatacgacatatacgtgagactgctgcaccttaatgaacaaaaagcgaatacttcacttcagcaattttttaaggaagccgcagaagaggatgtgattgatatccctaaaaacatgacaagcatacatgtcattgactgtatcggccaacatgaacccattaataatgccggaattgccagaaaaatgaacttatcgaaagcgaatgtaacgaaaatcagcacaaaactgatcaaggaagaattcattaacagctatcagctgacagataacaaaaaagaagtttattttaaattaacccgtaaaggcagacggattttcgacttacatgagaaactgcataaaaaaaaggagctggctttttaccaattcctcgattcattttcacaagaagaacaaaaggctgtattgaagtttctagagcagttgacgtcaacacttgaagcagaacaaaccgatgggactccagacaaacctgtaaagtaaacaaaaaggcggtgtacactttggctcatacaaaatcaaaggcagtattgatcttatacactgtttgcttcagtgcattttttgcatctttaagccagaacatttattcacctattcttccgatcattaaagaatcattccatgtttccacagctatggtgaacctgtcagtctcagtttttatgattgtgacagcaataatgcaaattatattaggagcgatcattgattttaaaggcgctcggatcgtcttgattaccggtattctggcaacggcagcagccagcatcggctgtgcggtgactactgactttaccttgtttctgatattcagaatgatacaggcagccggttccgcagcactgcctcttattgctgccacaacgatcggacagctgtttacaggaaatgaacgcgggagtgcaatgggaacgtatcaaatgctcctgtctgtcgcaccggctattgctccagttctaggaggattcataggcggagcagccggatacgaagggattttttggatacttgcggccatctctatcgttttgctggtgacaaacagcatcacctttcctaaagattctccaactgaatctatgcagcaagccaaaggcaatgtgttcgctcattataaatcaatatttacaaatcgaacagggaacgtcattttgactttaagttttgttctctttttcatttattttgcagtaattgtctacctcccaatattgctgacagagcattaccatatagatgtgggtatagcaggactgttatatttgccgctggcgctgagcacgattgcaggtacgtttctgtttaaaagaatacaggcaaaaatcgggctgcacaccttgtttatcggaagcaatgtgattgccgcctgcagcatcattttatttgctgttacacattccgtttctctcgttctcatggctctgacgctggcactgtttggcatctcgatgggggttattcctcccttgtactctacaatgattactaatgaatttgagcacaacagagggagtgcaatcggaatgtttaactttatccgatatacaggcatggcagcaggtccgatggtatctgcctacttgctcacaatgatgccgtctgccatgtcctttagcctcctaggccttggatttgccgcattgagcttttgccttcttccgccaatgttttcgccgcagaagcgcacgaaacaaaaaaagcaccacatgtaaaaaagctgcctttgcgggcagctttttttatttttttctaagcggctctaaaatgcctttttgaatcagcaaatggaagaccgacaggataacggatgcccatatcgctgtgccgaagccgtcgatttgaaagctgtcacccataatggacgcggtcatcataagcgtgatggcgttaatcacaaacaagaagagtccaagcgtcaccatggtgaccggcagtgtaaatataattaaaagcggtttaatcagcacgtttaagatcgataaaatgaggctggcgataatcgctgccccaatgctgctgatatggatggagtcaatatatccatcaatgacgattaataacaatgcattgactaaaatgctgactgcccattttaccatgtcatttcatatccctttctgacgggacgataaaaatccaaatgatataaatgagcaaaaccggcaagacacttgtcataatggctaagatgacagttatgactctgaggagtgatgcgtcccaattgaaatattccgcgagacctccgataacaccggcgattttcttatttttttctgagcgataaagcttattcattcgatcacctctgtgagtactttagtttgatggcgcctgttagtgattctgagaagacggtgatgttttgatcatgtgcctgatttgaagtgaacatcatttctttttgaatcgtatcatttttttccttcagcatctctacatccattaattcatgggacagcgtaccaagattgcttttcagctctgccttcactgcgagatcgtccggaattgcaagctctacatttccagtcgttgtttttgcataaatggagcggcagtctgattctgttacgttaatcgcaatatttccgttaaagctttgaacgtcaatggattcgcttttccctcggagatcgatcaatccgttaatggtttccgcttctatcgtaccgcagctgtggcttgcgagcttaatttgcccgttggccgtttcagctatggctttttcggctgttaaatacgagaacgacagcacgccgtttgtcgttttcgctgagaactcttttacatgtaaatgttcccctctgactggaccgttaaacagcttcacccgaatcttatcatactccttctgaggaatatacaaagtgacattcgttttcatcgtctttttctcagtacggataaaaaacttattacctttgatttcacattcaatatgctgaagaaatgcgtgtctcgccgcatcctggctgtcagcgcgatataccttcgcctggcattccgctctgatatcgtcgtcttcccaagggacgatatttacgctgccattggcaatttgcagctcaacactggaaaagtcagtatctttaaattgaaaaatgtgctgaacatcatacgcatggccaaagtttaaatcaaggtcaacttccttgacctttttcacagcagaatcaatccagtcaaacagcttggctcctaaagacggtttgccgctttctttttttgccgttgtaaatggctcttcctcgtcatgaacgtgaactgagagcgctgtgattttctcttctttttccttgtagtcgctgtcaagcttttcaatcagtgtcaaagcttcttgtgctgtaagctttccttcctcaacaagcttaaggattcgttccttttcttgcttcattacgatctcctccccattgtctacttatgctgcacgcaggaccttaatgccctgaatcacattccaaatgataatgccaatgacaactaagaaataaataaccgctcccccgatgattacaaatacaggaagcaagctgtctccatcaatcgcaacggctccgccaagtaaagcaataaaaaggaacagccagccgacaaacggaacaatgtgagaaataagagagcgtatcgcatggcgttttgtttctttctcatttacaacaaaatatgcgacaatcggcacaatgattggcgcaatgaacacactgaaataacaaagtgatgcaataatagcttgattacggttcaattcattccacactcctattgtgaattgtccatgacaaaagatcagggacgttttacttatttatacgtttaaaatctcttcaggtttcaaattcattctttagacatgctccgatttacggaaattggattttaaaaagttttagaagtagaatcttccggctataccgattacaatatgtaaaaagcttacggcaaccaaggaggctggacaagcaatggagaaagatcccagtgactatacagtaacacaagaatcagtgttaaagctgattcatgaacaaaaaagaatgaatcgtgaaatgatcgccgagcttgagcagattcacggacccttcccgatctctcacgatatccaatatataaaagtgctgctcgacagcagcaacacgcatattgttcaagatttaatgagtgtaagtaagcagctgtataagaagactttgtaattgcggaaaacatatcattcattataactgaaacaaagttaaaggttagatgacaatatcttgccttttttgttttgaaaaaacaagtgattccctggctgtcacaaaatgattgtaacaaaaaaagcctgccggcacccagttaatggactctgtcggcaagctgtaactatcagaaagagatagccgttcaaaattaacgtaacaattgaagcacgttttgcggctgttggtttgcttgagcaagcatcgcttgagaagcttgagaaagaatgttgttctttgtgaactcgctcatttctttcgccatgtcaacgtcacggatacgggactcagcagctgtcaggttttcaccagaagcgcttaagttgttgattgtgtgctctagacggttttgtaccgcaccaagtttagcacgttgagtagaaacttgattgatggctgcatcaatgcctttaagctgatcatcaaaagaagtagtatcaaattttgttacatcaagagtattcaatttaacagtatcactacctaagtcttttgctgccatgctatcaattttaacgttaagctgttgaccagcattcgcaccaatttggaatgtgaaaccattagtttcagttccatctaacaattgctttccgttgaattgagtacgatttgaaataccgtcaacttcctcaataagcgcatccatttcatctttaatcgcaccaagatcttcatcttgctgtgtacctgtgtttcctgcttgaacagtaagttcacgcatacgttgaaggatggcatgagtttcagtcaatgcaccctcagctgtttggataagagagattccgtcttgagagtttttagaagccatttcaagacctctgatttgtcctctcattttttcagaaatcgcaagacccgctgcgtcatctcccgcacggttgatgcgaagaccagaagaaagtttctccatgttttttgagctcgcactgttgtttgaagacaaacggtttagtgtgttaagcgctgcaatattgtggttgattctcatgtgaaaaatacctccatgtgtatatgtttttgaaatcaaagacttccttttctttgatttctggcgtatcagattccaataaagcttctaacctatgtagattcagttattgcttaaggatgcctttaagccccttaatagggtttgtctgcttaatttggaaatcatcattcgcctttcaattcatatatcgacagcaatttgtaaatgtttaggcgttttcccaaagaaattttacccaaagacgattctaaacctattatgccgtaaagaaaaagcttgcctgctaagcccaaggatggacttgctgacaagctgtcccctcttaacagagggttttaagatgtagctgtttctttcgcttttaagagcgatttcatgcgtgttttgtcacgttcgataacaggcttcaaataacggcctgtatacgattcttccacttcagtgatttcctcaggcgttcctgacgcgacaatggttccgcccccggctccgccttccgggcccaaatccacaatgtaatcggccgtcttaatgatatcaagattatgctcaataaccagtacagtgtctccgttgtctaccaaccgttgcagcacgacaagaagcctggcgatatcgtcgacatgcaaacctgtcgtcggctcatctaaaatgtagagcgtgcgtccggtcgagcgtttgtgcagctctgatgcgagcttcacgcgctgcgcttctccgcctgacaaggtcgtcgccggctggccgagcgtaatataacctaaaccaacatcataaagggtttggagcttgcgtttgattttcgggatattttcaaagaaagaaagagcatcttcaaccgtcatatcaagcacatcagagatgctttttcctttgtacgtcacttcaagcgtttcacggttatagcgtttgccgtgacacacctcgcatggaacgtatacgtcaggaaggaagtgcatttcaattttaataatcccgtcgccgcggcaggcttcacatcgtccgcccttcacgttgaagctgaaacggccttttttatagccgcggaccttcgcttcatttgtctgcgcgaatacatcacgaatgtcatcaaatacaccggtgtatgtcgcagggttggatctcggcgttcttccgattggcgcctggtcaatgtcaatgactttatctaaatgatccaaacctttaatctctttatggctgccgggcttcgctttcgctttatgaagcttttgcgccagcgccttatgcaaaatttcattaacgagtgtactctttcctgaaccggaaacacctgtaactgctgtaaacgtcccaagcgggaacttggcattcacttttttcaggttgttttctgatgcacctttaatttcaatgtaacgtccgtccggctttcttctttcaggaggcaatgggataaactttttccctgataaatagctgcccgttaatgagtttggatcttccatcacttcttccggcgtacccgcagatatcacctgtccgccgtgaatgccggctcccggtccaatatctattaaataatctgctgccatcatcgtgtcctcatcatgttcgacaacaatcagcgtgttcccgaggtctctcatatttttcagagcgctgatcaagcggtcgttatcacgctgatgcagaccgatagacggctcatctaaaatataaagcacaccggataaacgcgagccaatttgagtcgccagcctgatgcgctgcgcctctcctccggacaatgtacccgctgccctgctcaatgtcaggtaatcgaggccgactttgtccagaaagcttaagcgctccacaatttcgcgcaaaatcaaattggcgatctgcatatccttctcagaaagggtgagatctttaaagaaggcaagtgcgtcggcgacagacagctcggtaatttttccaatgtggcgaccgtcaatcagtacggcaagcgcctctttctttaaccgatagcctttgcacgtcggacaagacttctgagacatatactgctccatttgctcacgtatgaaatcggagcctgtctccttatagcgtctttcaatgttgcgcaatacgccttcaaattgaatttcaccttcgcggatttgtccaaaatcattttcatatcggaaataaatcaggtcatctccgctgccgtacagcactttatccagttgatgcttcggcaaatctttgaccggcacatccatatcaatcccgtagtgggtgcagactgcctcaagcagctgaggataatattgtgagctgatcggtgtccaaggggcgaccgcattctccttcaatgacaaatcttgattggggatgacaagatcggcatccacttcaagcttcattccgagaccgtcacacgtcggacacgccccgaacggactgttaaacgaaaacagacgcggctcaagctcaccaattgaaaatccgcagtgcggacaggcatgatgctcgctgaacatcagctcttcctcaccgatgacatcgatcataacccgtccttcacctaaacggagcgccgtttccaatgaatctgacagccgggctgccacgccttctttcacgacaatccggtcaatgactacctcaatggaatgcttcttgttcttttctaattcgatatcgtcagaaagctcagccatctcgccgtcaattctgactctgacatagccttgttttctaatctgttcaagcactttgacatgagcgccttttcggcccgagacaatcggcgccagcacctgaagcttcgtccgttccgggtattccagaattctgtccaccatttgctcgatagtctgggatgtaatctcaattccgtgctccggacaatgaggcttccctactctcgcatataaaagacgcagataatcataaatctcagttaccgtaccgacagtagacctcggattgcggcttgttgttttctgatcaatgctgatggcgggagagagcccctcaattgcatccacatcaggcttatccatttgccctaaaaactggcgggcataagcagacagcgactcgacataccgtctctgtccttcagcatatatcgtgtcaaaggcaagggaggatttacctgatccggacaaacccgtgacaacgacaagctgatctctcggaatcgttacatcaatatttttcaggttatgcgccctggctcccttcacctctatccgatccatagccatttgttcatcatccttccgcttttagctctaaaagtaaatcgcgaagctccgcggctctttcaaagtcaagcgccttggcggcttccttcatttcatgctccatctgttcaacgactttctggcgttctttcttcgtcagtttcgacagcttcggcgcggcttttgttttgtattccgctttatcctcagctgctactgtggcacgaatgacatcgcgaatttctttatttatcgttttcggcgtaatgccgtgctcttcattaaaccgctcctgctgctcgcggcggcgttttgtttcattaatcgcaatttccatagacttcgttattttatcggcgtacataatgacgcggccttccgcatttctcgctgcccgtccgatggtctggatcagcgaccgctccgaacgaaggaaaccttccttatccgcatccaaaatcgcaacaagggatacttcgggaatgtccaaaccttccctcagcaggttgatgccgacaagcacatcgtacttgccaaggcgcaggtcgcggataatttcaatccgttcaagcgtcttgatctcagaatgcagatagtttactttaatgccgatttcttttaaataatcggtcagatcctctgacatcttcttcgtcaaagttgtcacaagcacccgttcattccgctctattctagcttgaatttcgccgatcaagtcgtcaatctgaccttcgattggacggacgtcaataagcgggtcaagaagccccgtcggacgaatgatctgttcgaccatttcatctgtatgttcaatctcgtacggccctggtgttgctgatacatacacgatattgtgcatatgcttttcaaattcctcaaaacgaagcggacggttatcaagcgctgatggaagccggaagccgtgatccacgagcacctgtttccgcgcctggtctccgttaaacatgccgcgcacctgaggaattgtcacatgcgactcatccaccacgatcataaaatcgtctgggaaataatcaagaagcgtatacggcgttgaacctggaggccgcagagtcaaatgtcttgaatagttctcgatgccggagcagaaacccatttcacgcatcatttcaagatcatatcttgtccgctgctctaaacgctgcgcttcaaggagctttccgttttcatgcatgaccttcagctgctcctcaagctccttctcgatattttgaatcgccttctccattttctcggcccgcgttacgaagtgggatgccgggaaaatcgcaacatgatctcggtcgccgagaatttctcctgtcagcgcatccacttcccgaatccgttcgatttcgtcaccgaaaaattcaactctgatacaatgctcatcacgggatgccggaaagatttccactacatccccgcgcacacgaaatgtaccgcgctgaaagtcgatatcgttgcgggcatattggatgtctacaagttttctgagcagctcgttgcgctcaatttccatttcagtccgcagtgacacgaccatttcccggtattcctcaggcgaaccgaggccgtatatacaagacacactcgcaataataatgacatctctacgctcaaacaaagctgatgtggcggagtgtctcagtttatcaatttcatcattaatactagcgtctttctctataaatgtatccgtttgaggcacatacgcctccggctgataataatcatagtagctgacaaaatactcgacagcattgttcggaaaaaattccttgaactcactgtaaagctgtccagcaagggttttgttatgggcaatcacgagagtcggcttattgacttctttaatcaaattagacaccgtaaatgttttcccagttcctgtcgcacccagcagagtctgatgcttcttgccctcctgaattccttttacaagcttttcaatggctttcggctgatctccctggggctgatatttcgagactaactcaaagcgatctttcacaaaaataagcctccgtttctttaacgaaatcttcctatagatatagtaacacaatggaaagcaaaatcactaaaaatacgaactaaagttcggtggttttttatttccagctgtttttgtgtataaaaaacctgcttttaaaacgtaaaagcaggtattcagtctttatattcattatgtccgatttattcttcttttttctctgcagcttttttggccatatacagtccgccagccacaagagacacaacatccaatcctacaataaaatacgtttctgtatagccttttaaataagaggcaaacagcaatgcagctgttaaagcgatcgccacataatgattaaaggtgactctagtaaatagaacaacaagcataaaagggaaaaacaatgcaaaaacggcttttgtaatcaacaaaaaccctcctcagggattcttcatctgatctgattatagtaaaaaatgaagaatcggacaatcgtgcattcgctccctctactacaccataccccttttcagccaaaatcaatcaccatatttgcattttggtgccggtcaaaacttattccatggtgccgctgttctaatcagcggcactttttttattacatcatcaagtccgccaccagattccgagaataaaagaaaataggcatagagtaccagtacggccgaatttttcaggataatataaccaacttaactattcattttatttaggactttctgcgtttgacagcattttcctgaaaacctacaattgaatgatagtgtttactatcatttttttaaacataggctccgcaataaaaagactagagagaaaaacaaaatgaatgaagaaaagaggggtttcaaatatgtattctgttttatttcgccaggcagaagagtccagccagttggctggagcaaaaggaatgaatttgattaaattgaccaaacacggtcttcctgttccggacgggtttattattcaaacgaatgcgctcgcacgttttatggaggacaaccagcttcaagagactagtgaaaacgtcgaaagcgggatcatttccggaacattttcggatgagctgaaagatgagctgactagttccttttataagcttagagaatcatatcgatccgtagccgtgcgttcttcgtctgcctcggaagatttagaaggcgcctcattcgcgggtcaatatgaaacctacttaaatatcaaaacagaggaagagtttctggctaaagtgaaagaatgctgggcctcatttttttctgggcgggtcagcagctataagaaaaaaatgaacaatcaaatcgcagagccgttaatgggaatagtcgttcaggggctgatcgattcagaaatgtcaggtgttatcttcagccgcaaccctgttacccatgatgatagagagcttttaatcagcgccagctacgggttgggtgaagctgttgtttcaggaagtgttaccccagacacgttcattgttaataaatcttcgtttgagattcagaaagaaataggtgcaaaggaaatctacatggagtctgcggcagaaggaattgctgaaaaagaaacgagtgaagacatgcgcagccgtttttgccttacagatgaacaagtgattgaattggctgaaatcacaaaaaaaaccgaagacctgtacggatatcctgtcgatatagaatttggaattgctgatcatcaaatatatcttctgcaagctcgtccgattacaaccattgatcaggacaaaaaggcggcagaagaaaaacgcagcttcatgattaccgacactaatatgaatgatttctggcttaacatggagtctaatattgaaggtccggtgagtccgttattttcatccttcatcgtgccggcattggaatatggcttgaagaagagcatgcaaaagtttccgattggtgtagttgttgatgaagtaaaactttatcgcggacatatttattccaaaaaccaaggcggacaacagcctccttctgaagactgtggcaaagagcttttcccgattttatcggagcatatgtatgacatcatcaatcacacatacctccctttttaccggacactggaccagctcgcacaaactgagcataccgcagaaagcgcactggaagcttttcaaaaactaaaggccttttatctcacggcttatgaagagcactttaatatcgttttcccgcaaatccttttaacaaacaaactgcaagcgatgtatcaggacattcaaggagagtccgaaaacgctcatttttacgagatgctgacaggaaaaatgaacaaatcactggaaacggaccgttgcttatggctattttctgtggaagttcaggagaacccgaaccttctggccatttttgaaaacaacaagcctgaacagctccaggagaaattggaacaaacagatgagggaagacacttcctgaagaacgtccatgaattcttgcaagaatacggatggagatctgttaaaagtcatgatctgattgaacaaatctgggtggaaaatccgtatttcgctctggccaatattcaaaattatgtccgtaatggctatcattttgacaatgaatttcagaaaacgaaagaaaaacgagagaaattatacaatgaattcttggaaaacatagaagatcccggtttacgcaccgaatttgaccgctattatcaatggacactgaactctgcaaatataaaagatgatcaccacttttatattgacgccatgctggatgccaaggcgagaatctttctgctgaagataggtgaattgctggcggaaaacggtgtcattcaagatcgtgaggacctttggttcttatatgatgacgaagtggaacaagcgcttcttcaccctgtatccctgcaagaaaaggctgaaaaacgcagacagatttttcatgagtatgagctggcccaagccccggcctacctcggcaccccgacaaaagaacagctcaaagctgctgaagaaattgtcggcgctgtgatagaggatgaaaaaaacacagagaatcatatttttggcattgcggcatcaagcggcattgcgacaggtccggtgaaaatcattcgggacgccaatgaattttctcaattcgcgcctggggacgtactcgtttgcaagatgaccacaccgctatggaccagcctgtttcaagacgccaaagcgattattacagacacaggcggcattttgtctcacgctgcgattattgcccgtgaatacggcattccagccgttctcggcacacgcacggcaaccgaaagactgcgagacggtgacatcatcactgttgacggaagcagcggcaaaatcacagttgtcagccggtcctgatgcgtccccctctttcttatacaagcggggcgggtgtatacttgtcctgccagtatattcgtgaggtgaaacgtattgagaccgacaaacaagagaatccttgacgctgccatgcagctgctcgtcaaaaaaggatatcgcgcaacaactacaaaagaaattgcagaaaaagcaaatgtaagtgaagcgacgattttcaggaactttaaaaacaaacaaggactagttgaggctttgctttctcagcattcttcaaacagaggcagcattttggaacaaacagaaggggatttgtacaaagacctgcttcatatcggaacctgtctcttggaggagctcgaacatagaaaagatatcattaaaatcagctttcgtgaaccggccatgtttcaggatgtcattaaccacgtcactgaatatccccaatctatgaaacagctattggttgattatctcaaatcgatgggtgagaaaggggttattcagacaggaaatgaagcggagaattccgacgtattcatgtcgattatcttcggttatttcattcaccgtctccacttaggagacagggtcatatcaatgccccaggaaaaaatgctggagcacagcacagctctatttgtcaaaggaatttctgctgattaactccttggcataataaaaaggaggatcccaatgagctcaagaaaagaatgggcgctgatcgtctcgctattattgggggccattctggttcccattaactcaacgatgatcgcggtcgcgctctcatctatttcccatacgtataacgagtccatcgcaagcatcacttgggtggttaccgtttatttaatcgtgatggcagtcacacagccgattgcaggaaagctcggtgacatgtacggcaataaaacaatgtacttatggggagtcggcctttttctaatcgcatctctaggctgcgccctttcaccgagtctgctcctgttaattgtctttcgggcattgcaggctgtcggcggggcattgcttacgccaaacagcattgccattatccggcatgttgtttctgaaaaacgcctaccgaaagtgtttggatttttcggactgggtgcgggacttggtgcagcactcgggccttttatcggctctatactgattgacagcttcagctggcattcgattttttgggtcaacatcccgttcctcgccattgctttatttacggcattaacgatgtttcctcaatataaagaaaataaatctgacgcgccgctggatatcatcggctctctcttgcttgcaggcagcatcgtttcaattatcctgctgacgaaaaatgaggctccatggggatatgcggtatacagtgtattgatacttctttttgttccgctttttttcagaagagaaaaacgtacccagcaccccatcattgactttgcactgtttaaaagctcaacctttacaaatgcgaatctatcagtcttgttaagcaatttgatgatgtatgccgtcttattgattatgccgttatttatgacgaaccaatttgggcttaatacgtctaacagcgggatggcgctttctgtattttcgatcttcatgtcagccagcaactgggtgggcgcgcagctccatcacaaatggggagccaaaaaaatcatttttctttcatttgccatgatggctggtgcgaatctattatttttgctgttaagcagctcgcattctgtcttgttcctcatggtctctcttatccttggcgggctcgcttccggagtcggcctgaccagcatgcaggtttcatcccttgccacagtagaccccggaatgtcaggagtggcatccgggattttctcgaccttccgttatttcggaagcatcatttcatcagccttaattggtctgatttcgggatatcacaccctatttatgattctctttgctgtatccatcatcggcgtttttgtttcattgggcatcaaatctgatgaaacggcacggatagaaaaaaactcagcgtgacacaaaacagcccggcatcgcatcttcctgcggtgccgggctgccttttatgatccagaagcggctgcttcgtcttcacggtcatcctttacgaagaggatgcccaattcatgatgttctccttcataagaagctcgctggtcaaaacgaatttctccattcaaaccgataatttcaagctttacatatgcacggttatgctgaagcgcttcatagaaatcagaaacgttcttaaccggtatgccattgactttcgttatgatttccccgattttcaattccagatcctcagccggcgtattggggataatcccaagcaccattaagccctgatcccttttcgagaaataaaacggagccgcgttatcattcactctttgctttatggacagaaaaatgcgccctaacaaagcagtacagaccgctgcacccgcaagcggcgtccacagtaagctcgctgcaccgagaactgcgacggcaagaccgagaatacaaacgcgtttcgctgtgatccttatactcgtttcaggcagcgatccctgtaccctttgtccaaatccgacaaagtaaggaatccatagaaaatggaatgagccgccgggaacagtaaacacgggccaccagctaaggtgcgattctaaaccattaccgggcacgagaaggaacagcggcaaaagccaaacccggtttgccagctgctgtccgatcggcaaaccgcggctgcttacgacaagtgccggtgatgttctcacatgcgcagaacgataagcaaccgctccttcagtgataatcagcaaacctagaaacacagccacagccggccaaacaactgcaaatccttgcggaaatctctccagaaagggctccgcctgatatatttgcagtccaaaacctatcagcatactcacactgacgatatatgcagcagacatccagtttgcgcgaagagtgaacgctgccgctgcagtgataacggcaataatcgcaagtaaaccgagaggaatcgatattccgagtccacctaaaataactgacaaaagaagacctggaatcagtccctttgtatatgtaaatttcagatcatcataaatatctgctattcttgtatgaaaggtttttcgttcccgtttgattcttacatagccgaaagccagggttatgatgataaaaaaccagaaaagcgggtgtaagaagaacaagcccgcgctttttaacagttcaattccccattgaacagacactatctctcaccgcctcaagccaaacatgttactcatattctatcaaatattaaatggcttggatatcctcaggagagtttatctctcttgcgtcatccacagcgtgacattcgatagtgaaaaatcctttaaatagtggtttacatccacatccaataacccgctgattagatgcatcgacctttttatatctgtcagattaattcctaatcgcttatggtttttcattaagtagttaaaataatgtttggcgcattcctcattaatgtcatttactgattcgacattggtgtaattgaccaaatatctgctgaacagcataagaagacttagtgcttttgtagctgaaaatgttacgtcttgtgttctgtcttttaattgttccactaattcataatattttttttcacgcacaatacttgccctcttcaattgtgaacccccattttctttatacagataagcacgggccagtataagcagcagtactggagtgctaacaagcattctcgctaacgttactctttaaatacctgtcgttcagctgccattaacctgattactgttctttttagaaccttcttatattgtatgaagtaaacaaagactaggcaacttgcaaaagtttcattttaaatgcatattaactcgttagaaagtctctctcatatattgatatcgggtaataacagtcctttataaatgtttatttgtgaaaatttttttaatttcttgtcaaaaactcattttttatgtgacttatgatccataatctctttaagcacaaagaaacaggagatggaataccatctcctttaattgacaaataatgatttcaatgctgtttgaagctgcaaatcatttttttcatctgattttttcttttctatctgctgatttaatgtctctgcagtgcgagtgtcgatcacaccggttttattcagcttgttttgatcctgaaaagccataaccgcttttttcatgtctttgctgaaatagccatcctcacgtcccggatcaaagctgagaccttttaacaatacctgcgcatgcttgacgtcttcattgttcatgtccactttaagcggctctttcagctgtaaaggcccggcggaaaaataatcgggctgcttaatcgcaatggtcggttcaattcctttcttatgaatccagtttccatttggcgtcagccacttgtaaagcgttaatttgatgttgctgccatcccccattggcacagcctgttgaaccgttccctttccaaaagacgtatcgcctacaacatcataatggccagcttcctttaatgcgccggcaagaatttctgatgcagaggcacttcctttatccgtaatcacattgacagggtacgcttttttatgggtcaatgttgaaaaataacgttttttatccccattgcgttcagcaatctgaatatacggctggtcctttgtaacgaaatgcttaagaatttcttccacactttgaagatatccgcccgggttgccgcgtacatcaatgacaagtccttctatttcttttttctcaagctccctcagcgcttttgcaaaatcctctgcggtgtgctcagaaaaagtagagatggcgatatatccgacagaatgcccctgtacttttttctctgatgcaaaaaccgtttcgagcggaatctcagctctcttgatccggaatgacagctgcttcttcgttccaggccgctgaatcttcattgaaacgctggaccctttttttcctcttatttttaacacagcgtggtttaaatccttgccggccatcgattctccattgatgctgataatttcatcattaggcttcaacccggctttttccgctggcgatttcttgaatggggaaacaataataattttgccgttttccatgccaacctcagccccgatgccttcaaatgaggaatcaagagaatcagaaaattgcttagctgtctgcttgtccatgtaaacagaataaggatcatttagcgtagacagcattccctggatggctccctcgagcagcttttctctatctactttttctacgtactcattcgaaattaactcatacgctttttcgattttgtccatagctttatcccgttcagagtcagcttgtgccgtcgcgggaactgctgcagtctggggcttatccatctcaagcaggttgattcccgcatatacaccggcgcctccgaacagcatgctccctgctgctatcacagccattattttttgattcatcctttactcctcctgtatgccagactgtctttaccaaaacctagagatagtatatgtaaaggatggagatttcatgtaatcatagaagaaaaagaaggcaaatgaaaagccgtcccgaaagcggaacggctttttcactttatactcgcaaaaacttgcggatggaagtcagacttccccatactccaattactgcgccgattgcaatcagcactagcgaaacttggaatacaaatggattataaggaagaagagagacaaatgatccttgaacctttggaacgacccatccgatgacgtattggtaagtgctcagcaccagtgcaatcggaatcacagaaccgaatacgcctagcagcaatccttcaaggaaaaacggccagcgaataaaccagtttgtcgcgccgacaagcttcatgatttcaatttcttttcttcttgcgaaaattgtaattttaatggtgttggaaattaagaacatcgccgtaaataccaggccgataattaacgcgattccgatgttgcgggaaacgccgactactttaaacaaacggctgacctcttcttttccataagtgactttataaacatgatccattttttcgatctttttcgccacgttcggcgtatcatgcggatctgtcgttttgacgacaaacgcatcattaagcgggttttcttgatccttcattgtcagggattttccgctgtcaccaaaactgtcaaccagctggtcaagctctttttctttagatgaaaaagtgacactctgaatgcccttcagttccttaatatcgttctgaagcttgtcctgtgccttctgatctgcagtcagatcaaccagcactttgatttcgacttgtttttctgcattcgtggccatgttattcaaattcagcataatcactaaaaacacgccgactaaaatcagcgtaacggttacagcactaatggatgcaaatgtcatccatgtgtttctcccgagagatttaaaactctcacgcaagtggcgcccgagaattttaatcatatgaaccatactcccctcttgactcatcacgcacaatgataccatcttcgattgcaatgacacgtttcttcatggtgtttacgatttctttattatgtgtcgccatcacgactgttgtcccgcggttgttaatttcctccagcgtcttcatgacttcccaagacgtatccggatcaaggtttcctgtcggttcatcagcaatgacaacatcagggttgttcacaattgatcttgcaatagatacacgctgctgctccccgcctgaaagctggtcaggaaattgtcgcgctttatgcttcagctgcacgagatcaagcacttcaagcacccgtttcttaatgacagacggctgttctccaatcacttcaagggcaaatgccacattttcaaaaacagtaagtttcggaagaagcttgaaatcctgaaagacaacgcctattttgcggcgcacgaaagggatctctttttctttaattgtcgcaagatctttatgattgattaaaatttgtccttttgtcggtttttcttctctgtaaatcattttaataaaagtagatttacccgctccgctcggaccaacaacatacacaaactcgccgggatgaatggtaacagaaatcccattgagcgcttttacgccgttcggataggctttatatacttccttcatctctatcatgaaatcacctaatctttttatatcattttatctatcacacggtcatactcttcgaatgcattcgacaatttatgacccattcatttgtaaaaagatgaaaaatctgaaagttccctttttcaatacacttcattatacgtcaaatttagacataatactattacagtttcttttcattcatattgtcaaggcataaaaacatccttgccggcactcggcaaggatgtttttatcttactttttttctgacagccatttggcaataacagcggcttcgttatcatctacaagcccctttggcatattgccgcggccgtttttaataatgctttcaattttgtgttcatcgtatttgcctccgacctcttggagattaggccctgacacaccttctaaatccttgccgtggcagcctacgcagctttgctgatataattcttccccttcagatgcagtggcttccgtcttgctgccagtgtctgtcttctcttcttttgcatcgtttgatccgcaggcagccaacagaacagaaagcgcaaatccaatcattagtatcgataactttgatttcatgttgagaagcacaactcctttacgatctcttccatattataacctcgtttaagcgcgtttgaaaccctcgcccagcacctcgctcgcgtctgctacaattacaaaagctgactcatcaatctgtttgacgatttgtttcaatttggtgaattcagtttgcccaaccacgcacattaaaatcggacggtcatcgtcagtatatccgccgactgcagaaatttttgtcacgcctctgtcaatcttctgtaagacagcctccttgacagcctgctcctgctttgtaatgatgagcgccatttttgaacgattaaagcccacttgcacaacatcaatggttttgctggacacatagacgccaagcatggcatataagccttgctcaatattaaatacaatcatagccgtaacaacgatcattccgtcaatgattgcaagacacttccccaatgacagaccggagtacttatgaatgatctgagcagccaaggctgttcctcccgtcgaccctttccctaagtacacaataccaattccgatacctatcccgacaccgccaaaaatcgccgccaggagttcatgatgagtggcaggctgaatatcccttgtcagaaacactactagcggcaaaaacacagaacctgcaagcgtctttagcccaaatttcccaccgagcaaaatgacgccagcaataaataaagggatattaataatccactgtacatacgctgcttcaaaaccatatgattgtaaaatcgtactgatcccgctgacaccgccggcggcaatcttgttcggaagcaaaaatacattaaaggacacggccgtaatcgctgctcctatcaatatgtatacataatcccgcaaaatccacaatgttttattccgtacgtccatcatatatcctccgtttcttccaatgctctccgatagcattttaatccttccctgattagatgtaaataacacccaaatacagtggtaatatgctaaagcagcagtgaaatcaaggatataaggaattaaaaaaacacacccgttgcatcaggtgtgtttttcagcttatgaaagcttagatcgcaggtaggcatcaataaacgtatcaatgtcaccatccattacagcttgaacgttccccatttctgtattggtccgatggtcttttaccatggaatacggatggaatacataagaacggatttggctgccccagccgatttctttttgttcaccgcgaatttcatccagctctgcctgctgctcttcaattctgcgctgatacagcttggccttcagcattttcatggctctttcacggtttttaatttgtgagcgctccgtttggcatgtcacaactacgttcgtcggcaagtgagtaatccgaacggctgaatccgtcgtattgacgtgctgtccgcccgcgccgcttgcacgatacgtgtcaactttaatatcctccgtacgaatatcaatatcaatttcatcgttaaattcaggcatgacttcacatgaaacgaaagatgtgtggcggcggcctgatgaatcaaatggtgagatccgcacaagacgatggacacctttttctgctttgagatacccgtaagcgttgtgtcctttgatgagcaatgtcactgacttgattccagcctcgtcacctggaaggtaatcgagtgtttctactttaaagccgcggcgctctccccatcttgtatacattctaagaagcatagagccccagtcctgtgactctgtaccgccagcaccagggtgcagttctaaaatcgcgttatttttatcatacggttcgctgagaagaagctgaagctcaaactcattgaactcttttgttaatgattttagttctttttctagttcaagctggagatcagagtccggctcttctttcaaaagatcatgagtcatttgtaattcttcgtgggattcattcaattttttatacgaattgacataatcctttaaaccgtttgcttcatttataaccgtttgagctttttgctgatcattccagaattccggatcagccatttgttcatctagctcagcaatgcgggcctcctttgattcgaggtcaaagagaccccctaaagtccgctaaacgagaagccatattttcgagctctgctctgatttctgataattccatttcattcacctcattaaaagatccgcaggcgcctgcaggcgccgcggtcagtaaacttgccggggcgaactattcagtacggccgcagcaatttttatattttttcccgcttccgcagtggcatggggcatttcggccgatatcaaccactttgcgaaccggtgctttctttgcttttttgttatcgtcgccttcttgcggctgatgagctgttgtttggccttgtacaacctcttcacgctccagattgttttcaatctcagctttcatcacaaattttgcgacttcgtcctcaattgattcaatcatatgctcaaacatcgcaaaaccttccatttgatactcacgaagcgggttcgtctgcgcgtaagcacgaaggtgaatcccttggcggagctgatccatcgcatcaatatgatccatccatttagaatcaacggcacgaagaacgataactttttcgaattcgcgcatttgctctttgccgaattgctcttccttctcattatattttgtgatgatgcgatccataatgagctcaagcatttcatccggttctttgccgaagatatcgctcttctcaagcgcaccttcatcaagataagttgtgttgataagatcaactagaccgtcaagcttccactcctcaggaagctcttctcttggcgtataggctgcaattgcgcgttcgagagaagacttgatcatattttcaacgatttcacgcaggttttcagagtcaatgacttcaaagcgctgcttataaatgacctcacgctgctggcggagaacatcatcatattgcagaagctgtttacgcgaatcgaagttattgccttcgacgcgtttttgagacgattcaaccgcgcgagataccattttgctttggattggagtagagtcgtccatgccgaagcggtccagcatcgccattgtccgctcagctccgaatctgcgcatcaattcatcttccatagaaagataaaattgagtgatccccgggtctccctgacgtccggaacgacctcgaagctgattgtcaatccggcgtgattcatgtcgttctgttccgactacagcgagtccgccaagctcttttacaccttcgccaagcttaatgtccgttccgcgccccgccatgttagtcgcaatcgtaactgcgcctttttggccggcctcttcaatgatctgcgcttcacgttcatggtttttggcatttaacacttgatgcggaattcctttgtttttaagcagcttagaaatcaattcagatgtttcaacggcaaccgtaccgactagaacaggctgtcccgtcatgtaacgctgtgcgacatcctccgcaactgccttaaactttccttccatcgtgcggtaaattaaatccggacggtcatcacggacaacaggcctgttggtagggatcgtgacaacctgcatgttgtagatgttgcggaattcttcttcctctgtcttagctgtacccgtcataccggcaagtttttcgtacattcggaagtagttttggaacgtaatcgtcgccaaggtcatgctttcgttttgaatctcaagcccttcctttgcttcaatcgcttggtgaagcccctcactgtagcggcggcctttcatcagacgtcccgtgaaggaatcaacaataacaacctgtccgtcttccactacatagtcaacgtccttttgcatcgcaacgtgagcttttaaggcctggttgatatggtggttgagcgcgacatgcttcacatcaaagaggttatcgatgccgaacgctttttccgccttcgtcattccttcttcagtaagctgtacagcttttgttttgatatcgtacgtgtaatccttctccgcttttaacgtacggacaaaagcatttgcctgtacgtacagcttagtggattttgcagcttgtccagaaatgataagcggtgttctcgcttcatcaattaaaatagagtcaacttcatctattaccgcaaaatgaagcgggcgctgaaccatctgctctttataaagaaccatattgtcacgcaaatagtcgaagccaagctcgttgtttgtggagtaagtaatatcagcggcataagcttcccttttttcgtcttttgacattgagtttaaattcaaaccgacagtcaaaccgagaaactcgaaaattttccccatttgctcagcgtcacggcttgccaagtattcgttgacagtcacgacgtgtacgcctttaccggttaacgcatttaaataaacaggcaaggtagacgttaatgttttcccttcccccgttttcatttccgctatatttccgtcatgaagcgccacgccccccatgagctggactttaaacggaaacatgcctgttacgcggcgtgaagcttctcgaacaacagcgaaagcttcaacaagaagatcatccgttgtcgcccctttttcaagacgctctttaaattcaattgttttatgtttcaatgcgtcgtcagagagattttcatagtctccgcgaatcgcatcaatatcgttagcaattttttcgtatctattcagcgtacgttttgttggatcaaacattttatttaaaattccaagcatttataacgctcctctatcatcacatgcctattttagaggcatgtataaataatttactagtccatgtatacctctcattatcatatcataccttatgttatttccaaagaatttgcaaataagaaaaacaaaaaccttccgcggacatcacggaaggcttctcttcattattcagtcggttcaattaagccatatttcccgtcatttctgcggtacacgacatttgtaaggtttgtttccgcatttgtgaaaacaaagaaattatggccgagcatattcatttgcaagatcgcttcttcactatccatcggctttaaattaaagcgtttctgacggacgatgtccaagctctcctcctcttctatgtcatcctgaaccgcaatatctgtatcagagccaagaccgtttgccaataaatattttggagagccctgctcacggaatttacggtttactttcgttttatgcttacggatttgacgttccagtttgtttgttgcgagatcaattgcgttgtacatatcctcgttatgcacctcggaccgaagcgccagatctgtcatcggaatcgtaacctcaaccctagactccttgtcattgtaaaacttcaagttgacgttcacatcagcatccacgctatggtcaaaatagcgctccagcttgccgatcttcctctcgacatgatcctttaacgcgggtgtcacttcaatattttctcctctgatgttatagttcatcaaagaacgcctcccttttattaaggatatgtatctatttctcttttaccctttacaattcctgctgaaacataaatcttttgtgaaaattcagtgaactttgtcgaattttgtttgtatttgctctgttattggcggttcggaggtatatgtatatgctgattgaacgaaacaaatacctcacacacgcctaattgattaaaaagggttccatacattgatgaatagacagcatccattttctataatgaatcagaaaatgttcctttaaatactcacagaactcatgagagggaaaagagaaagagaccaattgatcaaactccgcaaaaatttggtcaaatgctttcacacaaatttcagcacaccgcgaatccataatgaagagaagtgttgaatgtgttgaatccaaataaaaaaaggcttggatcagatcttggtagatccgatccccttctgtttttgataaattctcttcagcctctatcaaataacacaacccctcttcgatggtaaaaagaagatgataataagctgataaaagcgtataatcttcaatgctcttcaaggcactcacctatttacgcttgtcataatatgtgccgtcaatcgtaatgttgttataagggtttaaatacgtcgtatgcatcacacgttttcttttcatctgctgaagttctgttgcgattgactgcttcagtctttccatttccttcacaatcagctgatcccatgtcaaaataagtttcatctgctttcgctcttcttctgaaagcggcagagatatctcctgaatcagttcagaccgtgtagccacaaagtcttcaatttgctttaaaagttcatcgctttccggcgtattttgtatgtgtgacagcatactcttcgtctcagtgtatagttgatctatattattcatgcgatcccgcctgatccgtgccggtccttccgctcactttgaatggcttgtttccaagcatcgcgaaaatctgttacataaccttcaacctcagccagcatgcccgtatcatttttgatatttgcctgtaccaatctgcgatacatataatcgtacatcgcacccatagaagcggaaagctctatgttacggttaagtgtaaaatttaattcctgaataatattttgcgctttaatcagattttcatttttacgttccatatcatcattctcaatggcctgagcggcaagtcttataaatttcaaacagccattatacagcataagcgtcagctccccgggtgtagccgtattcactgaattttgctgataggctgtatatggattttggatcgccatgtgtcatcctccaaattacatttattgtacaagaagctgtgataaataggacgcttgttcgttcattttttgaatcgcagaatccattgcactgaattttgaataatagcggttttctattgtggtcaaccggtcctgcattttggtaatatcagtgctgatcgtatttaaatttttaccgattgaataatcattggttcccattgtcgagttgccggcttttgcttcaatgctcttcaccgtacttttcagggtgtcaccgatgcgtttcataatccctttatcactataggcgctgctgttcgatccacttgtaaataaagcggcgacactttgcggatcttcttgtattttggctttcagtttgtcttcattaatctctaaatgaccccgcatttggtaaacacttgaggttgtgatgccaaactccgtcaattgataggttttcccatccgcattaacttgagtataaaagtcagtccgcatttggttcgtgccagtgctgatgcttgaatcgtttctcagcaatccgcttttcgccttctcctcccagagctctacctctttatcggacatggcttctttttgttcactcgtgagtggcgtatagtctcggtatttttcttctttcagcttttcattcaggctgtcaaccatttcattgtatttatctacaaactctttgatttggttataaatcccgtcaacatcagtagaaacggatgtggtaacagggcctgtggctgcagttgtatttttaatcgagtaagtaacaccattcaccgtgaaattgtttgtcagcttctccatttcaaagccgttgattgtgactttggcatttgtgccttctttgtaagcagtgagcttattatcagcatccaaagaaaaaccaagctgaccggacataaagtcagctgtagcagagtctgctgcctgtatactgccccctgcacctgttgctttagaagaaaacgcaattgtttctacgtactctgtaccattccaaattttatctttaaaagctgatactcctagatctgagctgttaagtttagaaatcacattatcaatcgtatcggcgctcgtcacactgatgttcactgtttttgccgttgtctcgccaggcgcaacaacgttaaatgccaaattgtaatcgccttgtgtataacccgtataattactagccttatacgttgctgcggttgccaagctcgctacttcaacagtagacgaagaatttggtgcacttacgcttcctgtagcagttaacacagactcattagagcttgtcacagttttgctctgaaacgtactcggatatgtcagcttattattagacatatagtcttgcaattcttttatttttgtattgacttcacgatagctgtcacgctgccattcaagagtctgctttttttgcttcagcttatcaagcggcgctctttctgtctgcatcagctttgatacaatatcatctatatccattcctgacgccagacctgttattcttgtgaccatctcaaaccactcctattctactttttttcatctacaaataacccaagaaattcagtcatagccgcataaaaatcaagccaccgttttggtggaatttcgcggatcacttcatttgtagagtcctctattacctttacatagtattcatttaacttgtcatgaagctcgaacttcagatgaacttgcgaaggttccaaaagcttgttcatttcccccaccatttcagcaagattggtatctgaaacttgatgaacaggaacctcgttatcattatctttctgattatgtatttgagtatcataacgatcccaaacaggttgtaacgtagtgagcctttcaatgttcaattgatcatcccctatgccccaatctatcgtttatatcgactaaatcgagataagattacacatatttttggaaaaaaatcttctgttttagatttcttgtatggaaatacatttataaaaagttagtggagaatccggttattatatcatgagttagtgacagcaagggggaagtattcggagctagaaatattaaataaaagaccttggcgttgccaaggtcttttttaaaattaacgtaataattgaagtacgttttgcggttgttggtttgcttgagccagcatcgcttgagaagcctgagaaagaatgttgttctttgtgaactcgctcatttctttcgccatgtcaacgtcgcggatacgagactcagcagctgtcaggttttcaccagaagcgcttaagttgttgattgtgtgctctagacggttttgtaccgcaccaagtttagcacgttgagttgacactgcgttaatagcctcatcaataccttttagttgattgtcaaaagaagtagtagcaaaatctgttacgtcaagtttatcaactgtaacagtagtacctagagcagctgctcccatgtcagcgattttaacgttaagctgttggcctgcatttgcaccaatttggaatgtaaatccagtagtagcggaagatccgtctaataactttttaccgttaaattcagtgcgatcggaaataccatcaacttcctcaataagcgcatccatttcatctttaattgcaccaagatcttctgcttgttgtgtacctgtgtttcctgcttgaacagtaagttcacgcatacgttgaagaatcgcatgagtttctgtcaatgcaccctcagctgtttggataagagagattccgtcttgagagtttttagaagccatatcaagacctctgatttgtcctctcattttttcagagatcgcaagacctgctgcgtcatctcccgcacggttgatacgaagacctgaagaaagtttctccatattcttttgtgctgcaccgttgtttgaagacaaacggttcagtgtgttaagcgctgcaatattgtggttaattctcatttttatttcctccctgaatatgttgtttaggcacgtccttgtgcctcaattttgtaatcggcggagccatttttgccctctcccggctacatcattaatatcggattgtctctgattttgttaatacaaaaataaaaaaatcctcactttttttgtgaggataatgcggagatcacatcgctggataacgctgctgcacggttattttcttcctgaatggtcaaataaatttctttcctgtgaatatcaatatgctttggggcgtcaattccaagcttcacttgatccccctcaaccgcaatcacttttacttcaatatcagcacctatttgaatcgcttcgcttattttccgcgataaaactagcatgattctcctccaatcgaatgctttgtcgtatatgaggagtcgtgtaaaacgacttgcttagccatcatgttcttgcgattcacaataatgggagccaataaattcgcagtagacttttcaaatggctctgccatagtcaatattgtcatgacttctacgtcttgaatattatcgatatccaaaagttcagcagttgattcatcaagatcaaattcataattcttaaaaaagataaacggacttacgacgataaacgcaagattttctgaagtgacggactgcagtgccacgaatggagagtcttctgaaagcggaagtatgacaaattgtttttcttctaaaaagcctggaatcccgctttcaaaaagaatgatttgttcttcttttatgttcatttggccatggtacttcgtatgaatgatcattgttcacgatccttttctttttacttttcgggtgattctttcgggtattctacatctatatttaaatcagggtattggagcatgtcaaccttaacatttcctggcgtatattcaacaattggcttatgcggctcagcctgaataacaggctttcgcggcgtaatctgaacatcaagctgtgacggagtatattgtattttcaccctagatagagaaggagcataattttcgcctaattgaatttggtgcatttcagagttcctccttgcttgtgaagcgattgggttccccttattttcaatcctcataagctcgtcgccttcttctgcagtacgcgctattccctccattacatcctcatgcccttgttgtgcggcttcttcaattctcttgaaaacatgctttctgtctaattcttcccatgcttgtgtctggtcaatcgtgagttttccaggtgtcaccgatatttccatttccgcactcggctgttcgatctctagatcagcttgaggctgctccatttttaagctggcaggcgtcgttgttaaaccaatttttccttgaacactatgcataatcaatctgggaatctgcatcactctacctcctgaactataaaaaaagcgaactcctgagagccgcttactttaaaaagtcaattaatgtaggctgaacaatttgcgcattaacggccagagtagccctgtgcacactttgctgcgcaataaattcagttattacttcttccagttctacatcttcattgtctgataacactttggtagctgtttcttcttgcgctgacagtcttgtattaaccaattcaagacgattatatctcgctccaagatcagatcgttcagcactcatgccgtcagaaaaatgatcaatatcatctaaaacactgtccatgccatctagcgaaccagaatttagtgctttctcaaaagaatcaagcatttcaaatacattctgcccgctttcagaagtgcctccaaaagctgactttggatctgaattcactttcaatgacatattatttgatatattgactacgacatcagctgtatcagaaattgtataagttccgtctccgttatctgtaaccggaggcttatctgaatttgtgccattaaagatatatctgccgttcacttgtgtattcgcaatatttaaaagctgttcctttaactgctttacctctacgccaatcgcttgccgctccgactcgccgtttgtatcattttgagcttcaaccgctaattctctgacctttgacaagatgtcaattccttctgtaatgtttgtttctgtattttcgagccaggtaaaggcttgagaagcattgcttttgtactgctgcacttgagacagttgcgtattatactttaagcttttcattgctactacaggatcgtcggaagcttttgagatttttttccctgaagaaatctgcgactggagtttatccagcttcgagtagctcgaaccgatatatctcagtgagttttgctgtatcatgccttgtgttactctcatgtgactctacctaccttcctccaacacccatgccgttgatcactttatcaagcaattcgtcttgtaaagtcaccattcttgcagctgcattgtatgcgtgttggaattgaatcatattcgtcatttcttcgtctaaagaaactgcgctcatttgctgacggtttatgtcagcatcattcagctgtgtttctgtattagacgccagtcgattagcctcttgagcttcgatccctagctcgccaatcagacccgcataataatctaaaacactagtttctttaccgttaatggttattttaccggttaaaacatttgctaattttgtagcatttgcgttatcgttggctgcgccagtcagtgagaaagcaatgtttgcgccttttgaatctattatgctgtcagctactttgatcttgcccgccgcgcccttggcaggttcagtttcaccgccagtaaaatcaaaaaagtctccgccttgttcaccgctcttggtcacaccatttctgtgcacttcattgaaagctttcgcgaattcaagcgccatattgtcaagatcagaaagcatttccgggtatacgcccttttcttggccatctgctgttatatacccataagactctataaatcctaaaagggatcccttgctgctaaaggactccgcctgtacagctgtatccccgattgaaatacttgatactaacccagtttcattatcatagttggctgcaagttctgaaacctcgtaatttttaccgtccaaaacagttcccagcgactgtttatttttatcaaggatttcaattgatacagttccttcagcagatgcaagtgcattcccgcctgatttgttgtagctgactttgatatcaaccattgaggataatttatcgatcagcaaatctcgctgatcatataagccattcggaagaagcccgaccggctctacttgtgcaatttgcttatttaaactgtttaactgagaaagcagagaattgacatccaacacagttgtatttagctctgcttttaaattcgattggacatttgtaagtgattcagaaatataattaaacgtttcagctacagcttgtccttttcgagcaacaacagaacgtgcactttcttcatttgtattattcgataattcctgcagggaattccaaaacgaattgagcacactgttcaagccgctgtcatccgtttcatttaaaacgccttccatttgggacagcgctttggccttcgtgtcatagtatccggcactgttgttttgaagacggtattggtagtcaagaaagatatctcttattctctcaactgattttccttgaacgcccgtacccatttgtcccgctgttttttctgcgtttttggatacagcagggaaatagtcagttgcctccaatgagacccgctgtcttgtataaccatcagtattggcatttgccacgttatttgcagtagtgcttaaagctgcctgctgagcgcttaacgcccgccttgcagtttcaagccccataaaggtagatgtcattttctgaattcctttctgctaagcttttgaatcaaacagtttcatttggctgcttttcggcagctcagctttaattgatttgctgtaattgaagttattttccttaggaaccagcatatcgtacgaaatagagatgaattgcagcgcgtctcttgtcagctgcctattcatctcatttacttttttcagacgtccgagaacttgagaaagagattcgtatagttgttccagctcttccttttcactgcctgaggttttggcgatacatgcggaaatagtattattttcgctatatccgagaaaggccgaagttgttttgatccggtcatcttctgtctgcgtgatcgcttgaatatatttttgctcttttgtcaaaatgttagaaagctcttttgttttgccggctttgagcgcttccgtcttttcttcagacagcgtgagcaggtgctcatgcagaacgcaaagtcgcttcaattgttcaataattgccttcgctgacatgggctttctccttttttattgctttttataaaaattaatcatatttttcgcgatatgatttgcgtctactttgtatgacccgttttcaatttgcgctttaagctgcgcaattttttcctgtcgtgaaccagcgactgcgtcggatgcatgttgcatttctttagcctgtgatgaaatttcaattttatcttgaggctgtgcagcagttttttgcaccgcttgcttatcataatttttttgatatggattaacggattgtgttccaaattgattgattttcataggattcctctcgctttccgttgcagtctttaaacaatcttaacccttttatcgactgcgttttcagttagtttagggaatcagctgtttttggtattataggcatagtatgtgtcttttttactattttctttctcgattttcagagcatcctcgtggttcaaatgatccatttgatccttaatatcggactggcaatccttgcagaacttgccttctctaatcgatgtcccgcacctttcacaagggtatgccaaattaggaagatgagtgatctgaattcgcttctgcctgatgaatttcaatatcagctcttcttccacacctgtttcctcagttatccggctcaaagttgattgccggttttcctgttttcttaaaaatttatagacagtctcaaatgatttttcttcttccttaatacacgcctgacatacggtttgcagctttgtttttaaaaataaagcattgcatttcggacaattagccagttctcccatcttttttctccttattagataatatgcctgtgtcaatttctagtgattatatcggcataaaaacagaatcatttagcttctgatcaaggtaaaagatgacactgaagcggcttttcctttttctaataagcagcgggctgcgaagtgcaaggtggcgcctgttgtataaagatcgtctattaaaatgatattcatacctgctgctgaattattttttgtatcaaaaatgcgctctgacagcaggcgttctgttttctttttctttgactgcttctcattattcaggcgaatgaggggatggtgggaaggccggtctaaacattctgccaagagctgtgcctggttaaaaccgcgctcttcttcccgttccttgctcagcggaataggtacaagaacaaaatgcttatcggggtaagccttagaaaaggttgaagaaaaatcacttttaaatgcatttatgatttctgcatctcctctaaatttaaaacgggagagcgcttctttcatcatatcattatatgtgtaaactgaacggttctgacgcaatagcaaactgtctctgatccttgttctccacacctcgcaatccctgcatacggcatgaacagattgaggtctgccgcacagggggcagatatgtcctgtgattttctttaatttgcttctgcaagaataacaaaccttttcatcaggctttagtaaaaaaagggctctccatgtaacatcttgagaaaattgcgaatcacataataaacagatcagtttatgaatgcctcctcctgcttcgtttgacataaatcgcttggactctctgaaactactgcagcagattcagccaaaatgacaagcattgctgtgtttttttgtttatctaccagctcagctttcgtatatgcgatctttttaagatcagtaacgtaggatggactcactttgtttaaagaaagtgccaatacatcgttttggcatacttggcaagtacaggccatatgaagctggtccatatatcggtcgagcagttctttcattacgatttcttttgaattgacaagcatttttacagctcctcatcatcggttatatgagtatactgtaccacgttttcaaataatggctagtctgtacattcaacttttgctgccaattcattcatttcttttatatgctttcttgcatcgagcatactctttgttttgccgaagtgaaagtaaatgacatcgccgtccgcatattctttatgccggccggttcttcctgcaatttgaacaagtgcgctttccgtaaagataggtgattccgctcctagtacacccgtttgcaccttggggactgtgacgcctctttccagtattgttgttgtgattaataaatcgagctgaccatctctgaattgctgcactttctcctttctatgcttgtcttccgcgtgcacagatgcggttcggcaatgaacacctctaaagcacgcagcagccttttccagaatagaaacggaaggaacgaataaaaaaacaggcctcccttcttttatatgaaactctatccatcttttcaccgctggcggaattttatttcggtttaatttcttcttccagtttccacaccatacaaagcgcggttcgggtaaaggtttccggtggtgtcttgcggggatgcgaactgaatgtaactgtccgttcagtgcttttctttttaattctttaggaggtgttgcacttaaataaacgagggtgctgtttttctttcttgctttttgaacagcgaattgaagggtttgatcagcagaatatggaaaagcgtcaacttcatcaatgatcataacatcgattgcatctttatatcgcaaaagctgatgcgtagtggaaatcataagcggagatagccgccctttgtcatcgcttcctccgtaaagcgctgaaatgtcagcaccctgaaaggcagccttgagtcttggagcaagctctaatacaacatcggtgcgaggtgttgcaatacatacacgcagtccttgatttaacgctgattctataccaggaaacagcatttctgttttgccagcgccgcaaaccgcccagatgaggagctcttctttttttgatattgcttcaattaaaacattggcggctttttgctgtccgcttgaaagcttgccatcccatgtcagcttaatagacttccagtttgattcattttcctctttccatgaatataaaggaacctcctcactcactctgcccatcatgacacaggaacggcaatacagcttattctttccagatgagtgataaaaagaaaaataccgctgatcagtttgtccgcacctattacatctatatctccgtttatttatggatatagaattttcagcagtgatatatccattcttgatatgccattcaatcatctcatcggaaaatgagagctcagtcctgagcaaatgacggcttcgaagcgtctgctgcaattcttttgaaaaggaaccgtttttttcaactggcacattcacatagcacgcctcctttcgaaacagtatgcctgaatgaatattttctgtccaactattaaaataagaatataaaaaaatctccgctctaaaaacggagatttggccttatttaaaacaccagcaaattcctaacgcaccttcacccaaatgagtgccgattaccgcgccaaaatagctgttataaaattcaacatgaggatattttgcagaaagctcttcaatgattttcgctgcttcttcctctcgattagcgtggataacagcagctcgcataggcaaccctttactcgcatcttcgtctaaaagctcataaattcgcgaaattgcttttttacgtgtgcgaatcttctcaaaaggcacaattaccttattgtcaaaatgaaggataggctttacctttagaagactaccaatgaaggcttgggcgctgcttaatcgcccgccgcgctgaagatgggctaagtcatctaccataaaataagctcgaactgtttttttcatttcttccagttcttttataatatcttccggcgatgatgctccgtttttgattaattcagcagctttaagggcataaaagccttgagccaagcagctgatctctgagtcaaatggatacacatcaatattgtcgaccatcgaatcagccgctgctgcactgctgaatgttccgctgatcccgctggaaagatggatactgataaccgcatcataagacttgccaagctcttcatacaacgcaaccagctcgccgattggcggctgagaagtcgtcgggagctcattatgttttttcacttcttcataaaagcttttccagtccaactcaatttcttcacggtaagtctcctccctaaaaacaacctggagagggatcatatgtatctgatgttgttcacgcatttctttcggaatatatgccgtgctgtctgttacgactgcaatattcatagcttcgatacctgccttattgctttataactctattgtaagggaaacggcagcctaaaaaaagacctgcctagtaaaaggcaagtctcctattatactatctcatttctacccagccatttttaatggcgaccacaacggcttgcgtccggtcgtttacattcattttttgtaaaatattgctgacatggtttttaacggttttctcactgataaacaatgattcaccaataccgcggttgctttttccgtctgcaagcatctgcagcacttcacattcccgcctagttaaaatatgtaatggtctgcggatttcagggtaaacctcatgttgagggtgtgcagaaactccgcttgttgcaaggcggcggaattcgttaacgaggttgtgagtaaccttcggatggaggtaagatccgccctcagccactactttaaccgcttcaattaatgtatcagcatccatctctttcagcagataacctcttgcacctgttttcagggcatgtgttacataattttcgtcatcgtgaattgatagaataattactttagattcaggatacagctctacaagctgttttgtagcttccacaccatttacgtttggcatattgatatccatgatcacaacatcaggatgatagtgctcaacaatacgagccgcttcgtccccgtcatcaccttcggctaccacttcaaaggtaggttcaaaatccaatatccgtttaacaccttcacgaaataactgatggtcgtcgataataacaatgtttactttagtcacaagccacgcctccttgtattattgttctatatactctagcattcggtcaatatgccttttggctctattttacaaatcatagtcaaagagataacggaaccttaatcataataaatgtcccaagacctattttcgaatctattgtcatcgttccttccaataaatctactctttctttcatgcccagcaagccgaatgatttgtttttcttctctttcgcttccttcaggtcgaaccctttaccgttatcttttatcattaaaatcacaaaatcctttgtgatctcaactttgactgtaatttcttcagattcagaatgctttagcgcattagacacagcttcctgtgcgagcctgaagagcgcaacctcaaactgaggcgctagcctctgatcctctgtttctccaatgcactgaaaatgtattttgaccttcccgttatattcctcggttgtatatagatattttcttaaagttggaatcaggcctaggtcatcaagggccatcggtcttaaatcatatataatccttctcacttcgtaaagggcattccgaacattttggcgtagatttttaatttcttggaatccgtcctctgcgccccggtcacggaaaatccgctcgattaattccgatctcatcataacattcgccagcatttgagcgggtccgtcatggatttctcttgagactctttttcgctcttcttcctgcgcctcaatgattcttaagccgaaatcctgttttgcctgagcatcagcaagaagcagtccaacttcgcgcaaatcctgattcaagtagttgagcacaactgtaatttggcttactaatgattctgaccgctcaatgatttcctgaagccctagcaatctgcgctccaaatcgtcccgccgttcgcgcaattgcttctcacgctgctggatcatcgtcaattctacctgcagcttatgggctttttcataagcattgcggatttcctcttcactgaatctatgaaaattacggctgacctcggataaacggtttctcgcatggcgagtttgcacttcaagtttatcgccaagctcaatcacttcatacacctgctgtttaatttgtttcagttcttcgaccagctgttcatactgctggcgtgactgctccccgatttgaaaaacttcgtccttgctcccgtcaacggttttcagcatcttcatcaaaatagaatccagcactttggaatccatctttgttttattcataatttccctccgtcacggcgttgtcatatatttttattataaatgtaattgatctgcaaattatgtcgaattataatgaaagaatgcgtatattctagaaaaaaacatttttatatactatctactctttatgataccaaaatacgcacaaaaattctaaagactgtacgaatttgtataggcagtcttttatgcttagcaggagggtcagctagcatgctgcacagctattttactgtgaaagaagcgggagaacacgagattgttatagaaaaatcgcgttttatctgtcatttaagccgtgtttctaccgaacaagaggcacaggaatttatacagaaaataaagaaacagcactggaatgcgactcataattgctcggcttatgttattggcgagaatgatcatatccaaaaagccaatgatgacggggaaccaagcggtacagcgggagtgccgatgctcgaggttttaaaaaaacgcagactgaaggatacttgcgccgtcgttacacgctacttcggaggcattaagcttggtgctggcggattaattcgcgcttatgggaaatcagtgtctgaaggattaaatcatataggtgttgtagaacggaagcttatgcgaatcatgcatacttctgcagattacacatggcttggcaagattgaaaatgaattaagggagtcacaatttctgttaaaggaaatccattattcagaaaatgttgaattcgaaacatacgtcgaagaaaaagaaacaaacgctttttctgaatggatgacagaactgacaaatggaaagagtgatattaaagagggagagttgacgtatcttgaaaaagccgtcaatcacataaaggagactgaataatggctgaacgcgttagagtgcgtgtgcgaaaaaagaaaaagagcaaacgcaggaaaattttaaaaagaattatgttattgttcgcccttgcactattggtagttgtagggcttggcgggtataaactttataaaaccattaacgctgcggatgaatcgtacgatgccctatcccgcgggaataaatcaaatcttcgcaacgaagttgtcgacatgaagaaaaaaccgttttctattttatttatgggaatagaggattacgcgactaaaggacaaaaagggagatcagactctcttattgttgttaccctggatcccaaaaataaaaccatgaaaatgctgagcattccgcgtgacacacgtgtgcaattagctggtgacacaacgggaagcaagacgaagatcaatgccgcttacagcaaaggcggtaaagatgagacagttgaaactgttgaaaacttcttgcaaatcccgattgataaatatgtcacagttgattttgacggatttaaagatgtgattaatgaagtcggcggtattgatgtagacgtgcctttcgatttcgatgaaaaaagtgatgtagacgaaagcaaacggatttacttcaaaaaaggcgagatgcatttgaacggcgaagaagccttagcatatgcccggatgagaaaacaggataaacgcggagactttggccgtaatgacagacaaaaacaaatcttaaacgcgctgattgaccgcatgtcaagtgcaagcaacattgctaaaattgataaaatcgctgaaaaagccagcgaaaacgttgaaaccaatattcgcattactgaaggtttagcgcttcagcagatttacagcggctttaccagcaaaaaaatcgacacattgagcattacaggttctgatttgtatttagggcctaacaacacatattactttgaacctgatgctacaaatctcgagaaagtcagaaaaacgcttcaagagcatttagattatactcctgatacaagcactggcatttccggtaccggaaatgccacagacgggactgacagctcaagcagttctggcagcactggcacaacaactgacgggacgacgagcggaaacagctattcgaatgacagcagcacaagctcaaacaacagtacaacgaattcaacaactgattcatcctattaaaaaatgcccggtccttttaaaggatcgggcatttttgcgcagaaaaaaactccggaacataagccggagtttttaattccttttcaccagccgtttataaaactttgtaaacggcttaaatttttcattcacgagtcctgtcacttctgctatgatttgcataaaaataattaaaatgaagataataaacaaagaaagccaaattgtggcacttttaagtacaatcgcactgatactgaaaataaatccaattaaataaataactaagaccgacatccgatgtgaaaggccaaaggccatcagtctatggtgaatatgcgacttatccggcgctgaaatcggctgtttgtttaatattcttctgatgatagcaaatgttgtatcaaaaatcggtacgcctaatataataatcgggataacgatactgaacaatgtgacacttttatacaggcctaataatgaaagaatcgaaatactataccctaaaaaaagtgatcctgtatctcccataaagatttttgccgggtggaagttgtaaaacaaaaaccccagcgtgctggcaataacgactaatgagagtgacagaatgagcacttttccgccggatagcgccatgacagcgatcgttgacaggccgataacagaaagaccggcagcaaggccatccaatccatcaatcaggttaattgcgttcgtgatgccgacaatccataataccgtcagcggataagccatccatcctaactcaaatcgttctgttaaaaaaggtactgagaaaaagtccatttttaagccagtgcttacaatcataatggctacacctaattgaatcaaaaacttaacttttgcacttaattgatatttatcgtcaagaatacctaacacaataatgatgaatgctccgactgtaattgccgtcatccttgtttctgtgtaaataccggatgcaagcacgcctgcaaccaccccgataaatatggccagcccgcccatgcggggcatgattttgtcatgtacttttcgattgctgggctggtcaactgcacctattttaatcgcaatcctttttacgattggggttatgattaaaactgtcagcagcgagacaataaacgcaacaacaatgcgaatcatgcgttcgtcaagcataaagaagtctcctttggaattaaatgaagtctttatttatatagagaaccgttccttccattataccttctccttagttattataacaagcttcatcaaaaagaaacacgtataatcaaaaaacgcgcatcccaatttataggactacgcatgtttttgaatccctgtatatttcataatttgtctaaataagcaattccaatcttgtgtgcgagcgatgtttcggcgcatttctttataggtttcgtctccgttttgttcgagaactttttcacaagctgctataaaatcaattggatgatcaccttctacatattcgtatacatacggcttttgcatttttgaggttgacggaagattagtgcctacgacaggtttccctgccgctaaaaattcaaatagtttcagcggaaacacagcttgattatacggtgattgtttatatggcatgatgccaatgtcgataagctccataaaatgcggaacttctttcggatctgccgggccggtccatatgacatttggaagcctcagcagctcttgaaacgaaacgtcaccattggtggcatccgggccaacccataaaaatgtccaatcaggcttttgcagggcggcttcttcaatcattttaaaatcgagcttcggtttaattccgccgataaaacctaacactgttccttctctcccctgcagtatactgcgatcgggagcttgtttatttgcagaaaacagctcatactccacaccgttttccacagtatgaaccttttctcgtcctgcagtcagttttttgtctacttccttgtgaagataatctgatgaacaggttattgaatttgctcgttgtataattctcagctctgccgatttaatgacttttcgccggaattcagacagcagatttgatcggccgctgatcggcgccgcccataagtcactgcagtcataaatgacctgatcccaaggatacagcgaagacagcagcgggaatccgggaaacgtgtaccataaacagcagcgttcaccgtttgcagaagcaggtgtaagctcatcgagtaatggggagagcttatgtctgtaaaaaacatctgtatatcgtccgaaacgaaacatttttttctgcagcaggtctttgacagcgaattgcctgatgccagaatggacttcctgaaactctttcccttgggcacgcggagccggacatacccaaataacttccttcgtttcctcctgagcagctaaaaattctgccagccggtgccttctgtatctcaattggtcttttccccattcagcagtggcaacgatgacatgaatgattgcttcttttgtttccaccttcatcaccttttctctctgtttgcggctataatctttttttcaccgcgttttttgcatattgaacaaaacaccatgttgctttcataaaatgaagccgttcgatctccctgtagacaaaccacgtttttttcgcagccttccatttgttgctggaaattgagttattgacaagccgatattcagccaggcattcattcattccataggcagtaaatcctttttttaaaagagacagccatgtggctaagtcctgtctcgttctgatattcggcatttggatctgtcccgtttgctccctgtcaatcatcaccgtcaagcagccgataattgtatttttcagggcgtcatcgtacgtcaggctttccggcgcatgaataaatttatcgagtggggtcccgtcctgcgccattaagctgtagcccgtgaaagaaaacgcacaggagcgctccatcataaactcaagctgcttttccagtttgtcttttttccatttgtcatcactgtccaaaaatgctacgtagcgcccttgagcgcgttccaacgctttgttgcgagcaaccgcagctccggagttctcttccaaatacaccacatgaattctttcgtctattttttcatactgctgtaaaatgtcgcgggtcccatccgttgagcaatcatccacgataatcatttcccaatgaggatggctctgatctaataccgaatgaaccgtgtcttcaatatagtcacgcgcattataggaaggtgtaatgacagatacgagaggtttccaattggtcatgatcacatctccatcgtatgattttaaaaggattccctgaaaaattcaggaatgacaacgaacataaaggcaatcgtaaggccaatcataacgccgagaactgctttctttttcggagacattccgccgcctgctgtctcacttacggtttcggaatcagtaacacttgccgctttcaggttaagctgtgtgtttttgagctcatacaaaaatctctctttatccactttggaatcctcgcttaccgactcgccttcaagcgcgtctatgctgctgcggatgacggcttctctttctgcatacagcttttgatcatttttgaggaaggtggaggaaatggcttttaagacagattccgttctatccttatcctcgtcgctatagcttaaagtcagtaacgatttggattccgttttgattgtaagcttctctttgatctctggtacatcttcatccttttcatcaggaagcgcctccttcaaaaaggagtcgctctttaatagaagcggaatctcttctgtgctgttataaaccggatgatcatagctccccacagccaaagtatcttcagctgtatagctcttttgatcagcgatctgtgacggcaggatataccccgccgcacctaatataattggcaccgctatgatcctaatgatatttttttttatgcgacgggctattcttatcaatatatcgttcatataagtctccctgctttttgtagtctgtttatctgtacatcggctcaggcatttgtctggatcgccttaacacattcacggcggcgatgacgagcgccataaacacccaatggaaaaataaatttgaaacagagcttgggctgatacttgataccaggaaactgaccatagcggtaataagtccttctgtgatcagttttgactgattttctaattttctttcataaaacttgtaaagcacccatatgaggtaggcataaacggacaaatatcccagcatgatgaacaaaccaaaattagcaagaatttcaacaagccagttatgcacctctgccacattgtcagtatcatatacagcataatgctcaagataataggatacatttcctgctccgactccgaatccgtatgaatcaaggaaaaaatgccaagcgtttttcagcagatttgcccgagccacatttgatggaagcctgtcatgaaatgaatgcagcgtctgcggggccagaaacagctcccaaaactttgaatagattttgctggcgaaaagaactgcgaaaagagcaattcccgccgccgacagccatatagccattttctttaaaacaggcggcaatacaatgaagatgtagacagcaatacctgcaaaaatccccagaaggctggctcttgaaccagtggcaaaaattaaatacaacgcacagagcgagagcacaaggccaattgccttgatgtatccattcttaatgtttttcatcatcgtgatgtaaaaaaagaagctgatggataaaaaggtcgcaaagtcattttgattaaaaaagaccgatgtcggataatgctgcttatactccggtccgctgtacaatgtggaactcgcaagatgatggtgggtgatatgattgtaaaaaccaatgatcatcagaaataccgtcatcaccagccaaatggcataaacaatcatcagccgctccattttttgcacgtacatgacaataagataaatgaagaagattcccattgccaataaggctaaatacttgaggccaactgttaccgacttggcccacagcagagaaacaaggccatatataaaccaaaaggcgaaaaagagcaatatcccttttacttgcagcccatgccatctttcaatatgggttcgattccgaaccatgccgaaaatatgaaggcaacccgctgcaatgagcagaagccggtaaaggaacaaactgaaaaatccaagatgaatagcgaaaaatgcattatttaaaaaagtgcaggcgatcaaaatatagattacagccataaagagccgttcttttgttgtaaatgcggttgcaagcgtcagtaaaaacaggccaattgccaacaccgcaagcacaacagccatctgcatgaaacctatatctttatggatggctcccagcaataggacgactccaaatatagcagcggccagtaacgctagcgtatggaccgctgatcgtttgatactcacatgtttaacccctttcctgatgtttcaggagccggcggccgagcctagcagccggcagcttcaaccaagtaacactttttctttttataaattgacgcttcccaagtctttagccaattcttcaagcggcaagcccggaaaatacttgtcagagggttccgttccccgaacagcgggacggccgatagagtgataaatgtatccagctgcctgcatctcttcaagtgaaaataaatttctgccgtcgatgatgactggctgttttaagaggttttttacttttacaagctccatttcttttacttccggccaatccgttaaaatcaggcatgcatcagtgtcttcaatcgcagcatacacatctgtgtaatactcgacctgttcgccaaggatcgctgaagcttcaggaatagcaatcggatcgtatgcttttacatgggcgcccagctgctgcagcattgggataatatcaagcgctggagcggatctcacatcgttcgtattcggtttgaaggctaatcccaggactgaaatggttctccctttgacgcttcccataacagtcaaaagtttatctacaatatgaacacgctgcttttcgttcgtttcaatgacagcttcgatgagcttgaatggatagcctgccgattttgcgatttgaagcagcgcggttgtatcctttggaaaacatgaaccgccgaatccaatacccgctttaaggaactttctgccgatacggctgtcaagaccaacaccatcagcaacttttgaaacgtctgcgccgactcgctcacaaatgtttgcgatatcgttgataaaggaaatctttgtcgccagaaatgcattcgaggcgtatttaatcatttctgcactttctaggtttgttttaatgacaggagcatggaatggctgatgaagttcctcaatgatggcagcggctttatgacttgttgaaccaatcacggcacgctccatattcatcgtgtcatgaatcgctgacccttcccgaaggaattcagggttagatacaacatcaaatgagtatctcccctttgaggctttttgaacgatagattgcaccagtttccctgttccaaccgggactgtgcttttatttacgatcactttgtagccgttaagatgctcaccgattgttttcgccgccgctttgacgtacgttaaatcagcttcacctgttttggacataggcgttccgactgcaatataaataatatctgaggcccgaatggcagacgggatatcgttcgtaaaggtcaggcgctgatccagcacatttttttcaactaagtctgcaagccctggttcatagattgggattaccccatttttcagacttctgatttttgattcatcgatatcacagcaaacaactttattgccgatctccgcaaagcaagtgcctgatacgagtcctacataacctgttccaatgacagctatttttttcacagcgctcaaccctctcctgtaaaatgatcttcctatttatattggtcgcagtgtcttacgattaaacggacgttttcgtgaccgtctgatactgatgatgcaaggccttggcgttttttcctgcgtcaaattgagcctgcacggtttcatacaagtcatctgctacttccggcttccatatttgctcatgttcgtaccgagtgatcgcttctgccaaggcttgagcggatttcggtttaatcagcagatgttggtgctttccgaacaaagacgacactccgccaacatccgtacaaataacaggaacccttagcgccagcgcctcaatcacaacagtcggcatcccctcactgtaagaaggaagtacaaatagatctgccgcaagtaaatagtctcttacctgatgattcggcacttggcctgtgacgatatgccccttctgcgtcagcgtcgattttgcgggaccatccccgacaaagactgccttaggagagtcctgcagcgattcgatcgcttcagacagttcaaaaatgcctttctctctgaccagccggccgacatagacagccagacgctgatcgagcgggagtccgagtctttttctgatttcctctttcgtctcctcattctcctgaaaacggctgagctgtatgccgattggcaaaaccgagctgtcaaagcccgaaagctttttggcttcttcctgaagcttgtggctgactgctaaaacaactgatgcagaacctacggcacgcttgaaggctttaaacgcacctttgctgtaatgcggatagacattcacatcactgccatgcaaggtcagaacataaggaatttgcgctgactctgacacgactgccgcagccccgcccgatggcatggcaaaatgcgcatggatcagatccggatataggtcgcattgtttcatggtttttaaaacggctgatgcgattctccgatgaggctgcgcccacttcagctggccgggaactgcccgatagaaaggccggtaaaccggtattccctttctaatctcatactccggtctggcatccttttttcgatatgtctttttcagcatgcggacaggcgctgaatgaaaaggccgtgggcatatcacagtgatatcaagcccaagtttttgcagctcttgcacctgtgtctcatgaaacacaccctcaccgggtttcatactgctcggatatacgcttgtgatccacaaaatcttcatgacaaacgtccttttcttagtagtttgcttttcgtttgagggtacgcttttaccaaaagaaagagatagcacagcgccccggctgcaactgaaatggccagccgcatttctgcctgcatactgaagtgttcggtactgaggcttacaccaaacgcgatgatgcccatcgccgcagtaatcagaaatggcttcataatcgactggaaataagctgaaaggttaagcttgatgacatatgccaaaagccagcgcccgatcaggaaattaacaacactgataatggcatacacccatgcgactgtcagcaggcttcccgtctgtacagctgcaaacagtgataatccgtacagcagcagcacgccggaatcccaataaaacgctaagtcagctcttcctttagccagcaacacagatccatttggattcatgagcactcttagtattccgacaatcgccagaacatttaggatcggaacagcagcaagccacttttctccgaaaaccgctgtgataaaggcgtctgacacagacacgagcccgattaacagcggaaacgaaacaagagccagcatttttgtcatattcagaaagccttctctgatcacgctgttttcatatttgttttttgcgaaaacagggaatgccacccgtgtgacaatcggattgatcttcaaaaccggaatggtgacaatctgataagcgaggttataaatccccaatgcttcagcaccaataaaccggccgatcaaaatcatatcgatatttgctcccagcctgttcacaagacgggatgaaagctgaaaggctccaaaagaaaagaaatccttcatacctctcaaatcaaaaacaaaagcaggatgccacttttttcggtatacagcccaatataaaatccctttactggactgcagcaggacttgagaaatcacgtacgccaaaatcgcatccatcataaaaaccgctatcgctaaatatccgaatgacaatacatttgaaaaaatctctattttgcttaacgtattaaaatgcagctgcttttgcagcatatactgatattgctgtccaattggcgcgatcaaaaacataatcgccagaatccgaaccagaaacaccagctcttctctttgataaaatcccgcaatgacaggactgctcacatataaaagaacaaacagcaaaacgcccgtcataatgttaagccaatacaatgttgacagctggcgctccgtcgcgtcgtctctctgaattaatgctgcgccaaaacccatatcgagcacaatctgggcgaaaactgtaaccgttgtgatcatgccgacaagcccaaattctgttaaggtcatcatatttccaagcagggcaaactgaacaatttgtatgattgtaatacacatggttgaaatacttgtccactttgcaccgctcatgatttgttttgtaatacttggcatcatattccctacttctttttaagctcagattgatggtgaataatggcattccgttttatcttgcaccatcacccgtccaaactactttacaagtttttaacataatttttaattctaaagtgaaagtcagattgcgaatgtaatataaatcaaatatcagcttttccttcggcgtcatatcgtaaccgccgttcacttgagcccagccgctcaatcccggtttaacagccagacgctgtgtaaagcctggaatctcattctggaatttttccgtaaatacgggccgttccggacgagggccaatcatactcatatcgcctttcagcacattaaacagctgaggaagctcgtcaattctcgttcttctgataaaagctccgatccttgtcacccgcggatcttgcttctgtgcccaaaccgctccagacttctcggcatctattttcatggaacgaagcttataaagcttaaatggtttcccgcctttccctacgcgttcctgcgtataaatggcaggccccggcgtctccaaacaaatcaaaattgaaaataccgcaatcattggcagcgcaatcgccaacccaatgagcgcaaaccaaatatccattacgcgctttattgccaaataacgagccgtcttttcagataatgtaaaagaatgtatttgctgaactgagaattcacgactcacattcatgcttttctctgcactcactgacacacacctcacgatttgtttgggatgttatgatgacctatgccagtcagtttagcagacggatgttaattggatgtaaatggtatgttaagaagtgtgaatttgttattttttctgacatttatccgtaaactttttattgttttagacacttttttttaaaattaagcatattgtttaaaaaaagagacaaatcattttactgatttgtctcttttcgttgtgaagcatttaatattgaaaataaaactttgatttagaggttaacagcttgtattgaacctcaaccattttactaaagaataacatggattttcgttccacattccttgtgtccaggacaattgcttggttatccacttttgcactgattttattttgagaagtgtttatcgcaaattcaattaatcgctctttctttacatgagctagctgttcaagcaaactctgcacgtttaccgtcaattttgtgcaattaggctctaactctatacgttttaccggtaatgagatttcagactgtccggtattcacaatcatttttgaatgatttggcaaacagatttgcttatctttaaaaataaatgataaatcttttgattcagtttcatatgaaagttctgcttctgtataggcatgtttctttatatcaatcgaaagattatcgtagttcattgtgaaatatggtcttgcactgaagacaaacaacgcattatgccctaaatacatcgtgtttgttgaatacttatacgcagcacgcttgtttccgattctcgctcttaatttatagccatctattgacgattcaataaagaaatcccaaacgcctaaatcttcttctgcagatgccagttcatcaaacttgcactcaaatgtaaatgttgaattttcatacttagccggcgcaatgtatttttccgcctttgtatcgcgatgaacaaatactcctgtcagagattgattttgattcgtttcatcatccaacaatttgtgtttaatggttccttgaatgctgaggctgtgatcgctaaattcaatattctgcagataatgttcaagcttatttttataatttacttttaataactcttcagaaattggatagcgttctaagctcggataacgtgcaattaaatccccgttatttacaacacagaactttttaatgtcttgttcttcacgctcatactgggttaacccctgcaaatcattattccgaataaacagcagccgcaatttgatatgcggaaggacaaattggtcagcctcttcaggtactgcatgaataaatgaggacaaatatttaaaccattcagctctttcttcatctgtcttcatttttattgtgacattttttgtccgcgaaaaatcgaaatgcctgtttaaaaatactgccatcagtttcgtttttcttgcttcttccagatcactagccttgatagcagagataatatcttccattgctccataaaagttctctgggggaacataagcgacactcatatgctcaccgtctcttttgaccagatagtaataatcatagtcagctgaaacagaaatcttctttgcttttaaataagcgttcattgtgaagacttgatcttccgctgcttttatgtgagtagggaagatgatttgattttcttttaaaagtgaggctttaaacagtttttggggtcccaatgtgaaaacaattttggaatcaaccaaatcaacatctgggtttgtttccttaaacattgatttgggaacacctcggccgtttatcccttttaacttacctaaagtaatatctgaatcattctcttttgagaaattgtaccatcttaacaatgcttcattgcctagatagtcatcggaatcaacaaacaggatgtattcacctttggcaatttttattgcatcattccgcggcgcacctggaccgcctgaatttacggttctttcaacaacaacaatattgtcatatttctttttatatcgattcaaaatgtctaaagatgaatccgtagatttatcatcgacacatataatctcataatcctcttttggcatcgtttggttaactaagctatcaagacattcggaaataagatcttctgaattatatacagggataacaatgcttattttcatcgattacctcactaccctaatggatcggttatatttttgcctgataattatatcaaaaacatctgtcaataagaataggcctaaccttaaattttgttaaacttttacatagcatatgtggtttaaaatttttctcattttatcgtataaaaaagcttgccggcaattcctgatgggttctgccggcaagccgctattgatgtctactaatttaatcccctaataatatccaatgattccttcatatattgcttgagctgctttttcttgatacaaagcactctttaacttacttgcgtcgttcgcatttgaaatgaacgccagctccgctaagctgctcggcatcgttgattctctgatgacatggaaattcccgattttcacgccgcggttttgagtattgagtgctttatagagtctgttttgtatttctgtcgcaagccgtttgctgttttctgactcatattttgtataatagtaggtttcagtaccggttgctgctgggctcgctgaattggcgtgaatactcacaaacaggtttgcattattgctttttgcttttgcaacccgctctgaaagctctaagaaaacatctgtagatctggccataatcggaatggctccaccattggaaagtttgctgtttacaagcttagcaacggcaaggttaacatctttctcttttaaaccattacctaccgcgccgctgtcataaccaccgtgtcctgcatccacaaatacctttttgcctacaattacatttttaagctggttcacgacatttgttgtcactgaaatagttcccccaagaactgtgaaggtattcttgctatttgatccgatgactgttcttgtcgcagtcggcaatgaaccggcgtcagtaaatagcattgggcgattttgcttcgccgccagcacagaacccgctaaagcatctgcatattgatagccattgctgacaaatgcagcttttgatgaagaataatactttttcgctatgttggcagccacttcaaaacggctgttcccgccgattcttgttggtgatggcaactggctgtaaacgctttttgagacactgatttctcccccgaccacaatagtcgatgttgttcctttgctgttcatcgcatttttcgttggttcgggaatagagcttgcagtcgtcagaagaattggaataccgttacgggcagcataagaaccgattgccagactgtcagcatatgccgttccatttgcgattactgcttttgaatttgaagacaattttttagaaatattttgagcaacttcatagcggcttcttccgccgatccgttccacattggaaatacccaattttttaatgtcgcttacaacgttgttagaaacactgatcgttccgccaatgacgatgaccttgctcggtttaagctggctgattctgtctttagtcggtgcagtcagtttagatgattccgtcaataaaatcggggcattgtatttataagccaaaggagcagcagttaatacatctgcatacgctgttccgtttgccacaacaaccgtgctcgcactgctccagccttgttttgatacatttactgcaacctcatatctgcttgctccatccagccttgtaacagagttggccgcaaacgcatttggtacaaataacacgactcctagtatcagtataggtatgcttttaagaaagatccgcaaagatagtccctccaaagattcataatgattcataaatcaaataacgaacaaaggaggcatctcgcctcctttgactctaacaatcttttaatagcttgatagagttgttcccggatagtaaaaacttaaaattgttgtataagattgtccggcagttgctctggcattggctccgtactgactcatgcctatgccgtgtccgtatcctttaccgctaatgagaaaggcgtttgtattgcttgagacagaagcatatgtactcttcatattggaagcgccaagcatcgttctcagctctgttgcaggtacagtaattgttgctgttttttcactgaggcttccatttgacaggatatagccatttgatttttctttcacgaaatatgagaatgtgacgcttgctgtttccggccgctgaccggcagttttctccgtgctgaatttcacactggatattttcgtgattttgatagactcggcattgctgtatttatttttaataaaccagcttttcaaaccgctcaaatatgatgagtttgtttcatttttagagctccaccatgaacccgggcttttcagattcagactgctcttatcaagctgggttttatttaaagacagagaccagctgatttgcgggtcgtacgtatcttttttggcgattaaataaggaagctggctgctccacacctcaccgctcgcttctgtgtagccgccgttgcttgaggaatacgtagcagaaatcaaattcccattgtatttcaaaacttttccttttgtagcttcgaccacttctgaagtttttgaattccagtcatatccgccatatacctgaaaagcggtggtgtcttgtacttcttttccggccgaactgatggaataagttctcgctgcgacagcttgggctttaagcgcttctttctgccagctggccggcatttcatgaggaacaacaccctttaaataatcttcaaaggggatattcacattgattggccgaacatatttgcctgactctattgtaaatttcatgtttccgagatatggcgttccgttcagactgatagaatttgtagttgcatattttttaggctgtgctgtaaaagacgttccaagcgtcttgattgcagtactgtttttataaagcactaggtttccgccggttaacttgactgtatatccagttcctgcaaaagtatctgccagtttgttctttagcgtatcactgatggaaatgcttcctccaagcagcgcaaatgactgagttccttttgacgctactacatcagcgactggtgacggcaggctgcctgattcaaccagcagtaaagggcttccctgctttgctgcaagcacagatcccgttaatgcatccgcgaatgtttggccgtttgacataaatacctttgttgctttcatatttaattctttaacgatattggcagatacctcatatcgtgaaacgccgccaatccgtttcacagttgccttcttttttaatgcagcttccacaccagtgctgacactcaacggaccgccgacaattgtaaccttgcttggaattttgtaatcactgcggatgttattgtctcccgcaagtaaaatcggataaccgttcattgcagcatatggcgcgattgacagggcatccgtaaagaccatgcctgtggccactactgcctggctgtaattccccatccgatcggctatgtttttagaaacctcgtaacgggttgctccgccaatccgatcgatagaaccatatttttttaatgtattttctacatttttagaaacactgattgtcccgccaatgatgagaatattgtcaggatttaattttgcaatttcgctttctgtttttggtgttagcgaatctgcgtctgttaataaaatcggtgcatcgtactttttggcaagcggggttgctgagagcgcatcggcaaaagcatcccgattcacaatgaccacagtcgttggatttgtccatccggcagaggcgacattattggcaacatcaaaacgggttgctcctccatatcgctccgtatccgcaattcttgagccgggaatttcatatccgcctgtgatatcgacatccaaacttgatttgctgcctacataattactcagcttaaccgaaatggttttatcagcggctttcgcagtctgcataaacgccggacatgctacagccgccgcagtgactgacgatagaagcaagagcttcatttttttcaaaacatggaaccccctaagagttttttattactttgtctcaagatccttaagcattaaagcgccatttgaatcttttgtatatttgacaacaactttttgcccttctgaaatgctgttcattttgtcctgaaggtctgaaccaacctgaatcgacgtctctttatcatcaatagtgactgcaattgtatggctgtccgccaaaccggcaaaagtgccttccttcgttactgtctcttctgcagccgcatcctggctgtccgaatttgtttctgctcctgatgagttctgagctgtgccgcacgcagacaaaagaagcagcattgagaacattaaaatagcaatttttttcattcctatatcacctctccactttttatcgacaattttaagcttattttaagatttctttcaaaacaacgaaaaatttttgcggattttcttaaaataccgaaacatttattacaaggagccgtctattgtaaagaatcagacaaattttagttgttttcaaatattaagaaacttataatcgtactagattacaaaaaagcgaggactttattatgagagctgaaaaaagaaagaaaaaaagaaaggcattacttgtcattttagccattgtggccgtatttgtactcggaactggcggctatgcatactacttatggcataaagcagcatcaaccgtggcaagtattcatgaaagcattgataaatcgaaaaagagggataaagaggtcagtatcaataaaaaagatcctttttccgtcttaatcatgggtgtggatgaacgcgacggcgataagggccgtgccgatacgcttatttatatgaccgttaacccaaaaacgaatacaaccgacatggtcagcattccgcgtgacacgtatacaaaaattatcggaaaaggcacaatggataaaatcaaccattcatacgctttcggcggcacgcagatgacggtagacactgttgagaacttcctcgatgtcccggttgattattttgtgaaagtgaacatggaaagctttagagacgttgttgatacacttggcggcattacagttaacagcacattcgcgttcagttatgacggttattcgttcggcaaaggagaaatcacactgaacggaaaagaagcgctcgcttatacccggatgagaaaagaagatccgagaggcgacttcggacgccaggaccgccagcgccaagtcatccaaggtattattaataaaggcgctaatatttcttccatcacgaaattcggagatatgtttaaagttgttgaagataatgtgaaaacgaacttgaccttcgataacatgtgggatatccagtccgattacaaaggtgcgcggaaacatattaaacagcacgaactaaaaggtacaggcacgaaaatcaatggaatttactactaccaagctgatgaaagcgccctttccgatattacaaaagagctgaaggaaagcctcgaaaagtaaaacaaaaagaagcttcgcacaatgtgcaaagcttcttttttatttgcctgtaaatgaatccggttgttctttccggtacccgtaatgaaacagcaattcttccacaatccggcgggaagcctctccatctccatacggattagaagcctgggacattttcttgtactcatcaggatcagttaacagctgttttgccagctgataaatgttttcctcatccgtccctgcaagtttcagcgttcccgcttccactccttcaggccgttccgtcgtatcacgcagaacaagcaccggtttcccgagagatggggcttcctcctgcacgccgcccgaatctgtcaatataaaatgcgatttcgctgcaaagttatggaaatcaatcacctctaaaggttcaattagatgtactctgccagaatcaccaaaatgcttatgagccgcttcccggacaacaggattcaggtgcacagggtaaacgacttgtacatcttcaaattcccctacaattctgcggatagccttgaacatattttccattggctcacccaaattctcccggcggtgagcggtcaagagaatcattttatcctcacccacctgatcgagaacaggatgtgagtaaccatccctaaccgttgtgttgagtgcgtcaatcgctgtattgcccgttacaaaaatagagtcggcctttttgttttcttttaataaattgtctttcgcctggcctgtcggagcaaaatgcaaatcagcaatcgcccctgtcatctgtcgattgagctcttccggaaacggggaatacttattccctgtacggagccccgcctccacatgaccgacagcaatttgatggtaaaaagcggctaggcttccggcaaacgtcgtcgtcgtatcaccatggacaagcacaatatcgggtttgatatctttaaacaactcatccaattttacaagtgcgttagacgtaatctctgccagtgtctgccgctccttcataatgttcaaatcgaagtcaggcttgatgtgaaacgcatctaacacctgatcgagcatctgtctgtgctgtgcagttaccgttacataggaatctatttcaggatattttttcaattcaagcacaagcggtgccatcttgatcgcttcaggcctggtcccgaaaacagtcataacttttagttttttcatatttgtcacctggtttctttgtttaacgggctgttagatagaatttcgattggtccgattgtataaatagatctactttcttctttattttaaagcaccatagctttttttcaatatttttactgcaaaagtacacactgacatcctttttcggaaccaatgtggttttataagaattaatggataaaacaatattggtgttttgtaaataagccggagcaaacttttgctgaacgagattccgatcaacctgtatcactgtcccatcagctgaactgatttgattttttattggtattaaaaactcttggttattgcattcgagcaataataaagattgcttcggaaaaaacaattggcttccaggaaatacgaacgttaaatgctggtccgaatcattatctctgaattcgactttcagaacttcctgctttctgatatccaccgacaaattatcataggttttagtaaagtacggccgtgcgctgaaagcatattccccgttattcccaatatatttagcatgttttgaataaggatacggttctctgctgctgccaattcggacgcgttttttatagccgtctatccccgattcaataaagaaatcccacacaccaatatcttcttcatgaatagccaaatcagtaaacttcgtgagaaattcaaattctccgtccttggaatacactggagaaatgattttttcagtttttctatcacggtgcacccaaatgccgtataaagtttgcatagcttgatgctctggttgtaaagccgtgtgggtaaccgaccctcttaatgtgaaagtgttgtccttcatttgaaattcgctcacgtaatgactgattttgtttctgtcatcaacaatccgttcattctctgccaaatgatatgagataaggctgggatagtttgctatgatatgaccatttttaactgacgtatattgggccatattttctttatcagcttcaaactgctttaagccctttaggtcattatggcgtacaaagtgtaattttaaccgcgtatgagaatgaacaagtttatcaatttcccgtggtatattttgttcaacaaaatgatgcagctctgtcatccatgtttgctgctcccgttcgtcctcgattgttacggtaaagtccgttgttctggaaaaatcaaaatgacgattcaaaaatttcgccataaacttcattttgcgattatgtgaaagacggctattacgaatcatatctatgattaccttcattgcgccatagtagctttgaggcgcaacgtatgcaaacgtcatatgctcgccatcatgctgtacagcatagtaataatcataatcggccaagacagaaattttgtccgcttctaaataagcctgcatgacaaatacctgatcctctgtagcctgtatattagaggggaaatatatgtcatgcattctaagcagtgagactttaaaaagttttgtcggtcctattgagtaaacaagcggagattttacaagatccgcctcaggtttcgtttccttaaaaatagcttgcgggaccgatctgccgtttacaccgaccattttcccaagcacaatatctgaatcatgctgttttgcaaattgatacattctctcgaacgcttcgattcctacataatcatcggaatcaataaaaaaaatgtattcaccgttcgcagcacgtatcgcttggtttcgcggctcccccggccctcccgaatttttttctcgttctataaccgttatattagaatactgttcactgtacttttttaatattgaaaccgtgccatcctgtgaacaatcatctacacaaataatttcgtactcattattcggcatggtttgttgaaccagactatccaggcagcgggagataaaatgttctgagttgtatgtgggtactgctgcagtgattttcaccatgacacctctatccttatcagcttctatttcattcgcaaaagctcatataatgaacaaaaatggtgcaaaaacgtactatttcgttatttcaaatacttcttcccatctttcaaataatcgggcttcactatattcagtatccattaagttctttgcgttttttccatattgaatggctctctcagggttgtcgtacaaataaatgatactttcagcaagcatgtcaatattatcaggttctacaagcattcccgtttcgtgttcttttatgagctccctcgggctgtatttcacatcaaaactgataacaggggttgcgcacgaaaacgattcacaaatcgcgagactaaacccctcaaattttgatgttaataatgtggcaagcgcctgctgataaaatggagcgggatttgcgacatatccttttaaatgtacattatctaacttaagatcatcgatcaattgctggtattcctcatggccgggaccgctgccatatatattcaggacaatatccggccgggatttttttacgattcccattgcttttatgaccttatcgatccctttttcctcatgatatctggccaccatgacaaattcgtttttcttcttttcatacgtttgtaatttttcaagccttcttggtgcatgaggaataacaaaaatattattgttcgactcaaaatccttcatgatatcttctttttgttcattcgttaatacgatcagcccgtcataatccttaatatgctccatcgcatattgatgattggttcgaactttgctgcctaacgtataaggataatttaaatgatttgagtgaacacagtaaaatcgttttgccaatcctgcacgcatttcatttacttttgaagcacttccgactccatcacagatgataatagggtccttttctttctcacataacgtttcaagccaatgtgtatgaaactggtgcttgtttttgaaaaatacagcttccttttcatcacggccaaacagcataactccttgactggctcctgttttaaaatggtaccattctgttaaataacagaaaccgtcgggtgctgtgtagtgaatttgattgatttttccgcttcttgtatcgaatatcacagttttatttacataaccgccatgaaagaattctcgctttgtcatttgcatattttcattgaaatgatctacatataaaagattatccgactcatcccattttttctttttaatatataagccattcttgaagtattccgtttctaatttttcctcattatgatacgcagcatatggttcttcaaagcgattacgattttgatcatagtaactttgttgcacttccccaatttttatatgcttatgctgatttttatagtcatcataaatattgaggatatttacatcagcatgcagccttccagcgctcttcagcacttgctcaatctgatcataattgtctttataatcaagtgtaaccaaatcgattttatggccgcgctccgcaaatgtaaaagatcttgacatcatagagcttgtaatgccgcctttttcaatgtctatttcatatattagtgaaaagatccttctcatcttcaagctccttcttctggtaaaaccttgtctgctattttttcacaaacagccgtttcattaattttttccgaaatccctcggcagtctgaacacgcaaataattattttctttttctaaagtaacttgccagcctgaaatactttgttttgataatggaatttcctttgaatcggttattcgcacacctgatgcaaagaagctattatcccactcggaacagagatacaattcaatggtggacaactgatctaatacagagtgaacacgaagtgtaccgcttacggtaaatattagttcttcctcgctgtttacttttgcgttaaacgtgctttcagtgccgctctttttattttttaatttccaatacattttatggcggccaacagaatggggaggaatgcagcctttaaattcaaccttggctgacagatataaatcggattttgattgccattctgccattaacagctcaacattcatatccttcaattgattattaaatggcacctgatctattagtttgtccacaaaacgcttgcgggtaaacggctcttcagaaacgtaataaatatttgtgcgaggccccgtatttttaattatgtcatgatatctcttcaaggaaggaaccacaaaagcatcaaggtggcctatttccttttcagggttttccaacatctcattcgtctctataaaacctagatacatggaagaatattcaactgaaagagattttaatgtagtatataactcaacttcagaagtcataaataaataatccgcttcctttatcaagcggctcagaaaataacgggcaagttcattttctgaatacaatacactgactatattctctttttcgtcaaaaatgacaattttttcagttgttccatcattcttataccattttgtcatataacaagtgccatctgcccttaaataaagatgctgcttcggtttgttagtgtccagatccatgtacattaagctgtgtacatatccagacaaatcatattcttcccttttaaatctttgcctgctttcattaaagtaatcaatgacagcaagttctcctgatgctgtaaacctttgatatttgatataacgtccattattgtaataacgataaattggcttatttggttcttgaatatatgttaaaccttcttgttcaatcggatgcttgattttatctttctgaggttcagaacctttaaagtagctgtacatattaataacagcagtatctttaaaagaagaaggcccattgggctcatgatgtaaagtgacaatttccattggataattccaatcgatcgtattgatactaaacttttttgcagcattcagctcttgacaaacaaatgctaattttggagtagaaaccttaatcgtcatcatctatttattacctttcgaataaattcgtacagtcacattttcagaactacattatatcacttttgctgagcaggctctagagatgaagaagctgttatatttcttgaaataccggatcaggtgaaactgttttatctatcaattaatgatatttttttgtatttcttcaaccccaaagtcactgaattgactcttgtttaatattggtttttcttatatgattaaatgtgtttaacagaatgaaaatagggtattgatgagaaaagaaactcaaacattttaaatactctgcattcaaaagagtgaccctaaatctgttcttaaggaaggtgctttgaaattgaaaaaagtacgtaaagccataatccctgccgcaggtctcggaacgagattcttgccggctacgaaagcaatgccgaaagaaatgcttcctatcgttgataaacctaccattcaatacataattgaagaagctgttgaagccggtattgaagatattattatcgtaacaggaaaaagcaagcgtgcgattgaggatcattttgattactctcctgagcttgaaagaaacctagaagaaaaaggaaaaactgagctgcttgaaaaagtgaaaaaggcttctaacctggctgacattcactatatccgccaaaaagaacctaaaggtctcggacatgctgtctggtgcgcgcgcaactttatcggcgatgagccgtttgcggtactgcttggagacgatattgttcaggctgaaacaccagggttgcgccaattaatggatgaatatgaaaaaacactttcttctattatcggtgttcagcaggtgcctgaagaagaaacacaccgctacggcattattgacccgctgacaagtgaaggccgccgttatcaggtgaaaaacttcgttgaaaaaccgcctaaaggcacagcaccttctaatcttgccatcttaggccgttacgtattcactcctgagatcttcatgtatttagaagagcagcaggttggcgccggcggagaaattcagctcacagacgccattcaaaagctgaatgaaattcaaagagtgtttgcttacgattttgaaggcaagcgttatgatgttggtgaaaagctcggctttatcacaacaactctagaatttgcgatgcaggataaagagcttcgcgatcagctcgttccatttatggaaggtttactaaacaaagaagaaatctaaacaaaaaggctattggacattcatccaatagcctttttttatttcaacatcaaagtcagtgtatgctcttcattatcaactgtgaagacaagatcagctgtattcacaagaaaacgatccttgctgctgtcatacaatacatcgctatcacttaaggatagtgacgccgggttgataggagcaatgttatgaaaaataagctctgttgctttatcattctccagcacatagctgattttttcataatcaaaatctaacgtttttctgccgtcagccgtatccccttcagtatatccattcaatttggattgaatgctggttctgctgtctcccaggtatttcagaaagtattcataggaagatgctgcgttttgcgagacataagacgtaaatgcagcggcatgcaattcagcatgtttcatgttagttgcaacagcgctctgtttcacataataagagtgcccgtcaaactttattttcgctgcttgtttgccttttgcagctaccgtcacttttgtaccgaatggcagtgtaacgtcagccttctgtttcaaaccctgatccttataagcagccgctttttcatttgctataaacccttgcttattgactgcggttaagcgttcctctgacttgccctttgcattgccatgatgattctccacttcattttgcgggatagcgccaaacgaagcaattgtacgaagcggggcattaaagaacatcgttcctgccatgaatacagtcagaatagacaaaatagcaatttgaaccgcattagccaatgatttcggctttttcttcttttggcggaaacgggcaaacgcttcaggatcttctttcttcctctcttccgtctgctcttttttatatgtctctttttcttttttagacagcttattaaaccagtcaataaacgctttatactctttgacaaccgtttttgtttcatcaaacatacgaagctcaccatagtgcatccaagcgacgcggtcacacatcttttcaatctggccgatcgagtggctgacaaagaaaatcgttttcccttgctttttaaaatcatttattctgtctacacacttctgataaaacgtttggtcccctacagaaagcgcttcgtcaataattaaaatgtcagggtcaatatgcacggaaatcgcaaaaccgagacgcgatttcatcccgctggaatagtttttaaccggctgattaataaaatcgccaatctcagcaaattcaacgatgctgtcatacatatcatcaatttctttattggttaaccccatcatcaaacacttgagccggacattgtcccggcccgttaattggttatttaaaccggcagcaatcgcaatcagcgacggctggccgttcatttcaatttcaccgctggtcggtggaataattttagccagcaggttagacatggttgatttccctgatccatttatccctacaaagccgattgtctctccctcatacacgtcaaaggagacattccgcacagcaaaaaaaccattatccttagccggaaaaaacaatccttttatcttgtccgattgttttttatacaaatgatattgctttgaaacatttcgaaacgaaacttttagtttcatcgtacaatctccttacgtattaaagaaagtcaacaaacttgtctctgaatttcatatgcagaatagaacccactaacaataaaaggaatgtgaacagccagaaatacagcgtgtacttcatgtcttggaaaaaccattttccgtctaagaagctgttcctaaatccttctatcagataaaaaatcggattcagcttaagcacaggcagaagattcggatgatttttcccgagctgctctgagatattccaaaaaatcggaagtaaaaagaacaataatctggttacggcctgcagcagaaattgataatctctgacaagcacactgattgtagagttaaacaagctaaatgaaaacataaacacaatcatgcagattaaatagtaaatatattgtatccaatgcaagctagggtaaacaccgcttgctaaaaggacaatgacataaacacccatcattacaaaataactaaataaatttgaagcaatcactacagaaggcagtgaactaatcggaaaattcattttcgcaaccatattgatccgtttaaatacactgtttgatccatccaaaatcgtcgggctaataaaaaaccacgggatcaaaccagccaacatccaaacaataaaaggaacttctccaatacctgttatgactggcttgctgttacgaatccccataccaaatacaaaccaatacgccagcatttgaatgagaggattgagaaactgccataatacgccaagataattcatctgatactgagactttgtctcatacgaagctaagcgcaaaattaaaggaaacgatgtcacttgctcttttacgattcttactaatgcattcattgtttatcttccttagacttaaatgattttttggatctttcggttaaagaaatttgaaagcaccggtgaatattgtaacagatgttgaggtttttttcacttttaaaaagtaaagagaagtccctcagaacttctcctaacattttgaagtgtcaatataaaacaaaccaacctcatttagcaactttattattatctaattccaaaatagcattataaatacgattcctattatttttatcagtatatgcaaaaaagttatctactctttttctatacttatcttccatacgactattgtttttcatataatagataactttatcaactaagctattatgatcttctattacatcaccaaaccccatttttttataatcataataatcaagtttaaaatggtatgatttttcgtattgataatagataacaggttttttctcatatgcaaaatcaaacgctacagatgaaaaatcagtaatcattatattagaagaattaaatagcatttgatagctgctgttatagtcggcaaactccacatactcatgcttttcaaagtctacaatctgttgctgaatatctgggtgcggaaaaaaagttattttataattatttttcttagcaaattcgattagccgttcatcattaatcaaagcattatacctagaaaagtattcactatctttaaatttcgggttgtacggtcttactccttttgcctgatctttcggtaatacaatatcttttctccaagtcggcattattagaagctgcttttctccttcactcttcttaagattatcgtatctcggaaatccacccaacaaaatattctcttttttatagttgtaattccctttcacaatagaccgatattcaggtttggcagaagtgactaataatttgatattcttactgtatttatttaaccattcagaatgatctgccattgttattccatgctgcaaaaagacaaactcaaaattaaataaatctctaaaataaatctccatattaaaaaatggatttacaacccatatatctgcatgtgtcgatattactttggaagaggataaggttaaaattttatgtctaaaagatctgtatggtataacctttccatattttttaatcctgtcgtaatccttgctatctttttttattataaagtatttttttgccccatcattctggttgattgcatatttaaagaggtgctcggcattatcatcagctttgtcttgtctgtctatgaataaccatactggttttctattaaaaatagtgaaaacatggtgtgctattcttgccacaagtgccttcttaatcgctgattttcttttttttgatttcccccctgatttatgaagggatttcaagaaacgaaactcttttataaatctatttttaacattgtttttttcgaacattaattttttataattataataaaagatataatcctttttagctgcataagcattaaataggtcatttgacaaacctgaatacttaaagaaccgaagctttgccatttttctttttttaccttttgctataaaaaattcaatatggtgatttccagcaagatagcttttcggtatatctatagaaaaaccaggatatttttttattacctctcctaaacttatataatcgttatgacttctttttattttcttagcttttattttaatttctccaattttagcataaaaattaaagcctttagaattaaaaagagagctccaaaatccttcaatatgaatagaatcctcattttcttctaaaatctcaatagttagagtttgattcgataacttcgaaacaattttatcttctctgaataaataataatcttgttcagtttctttttcatatacatacttactataattttcaccgtgttttatttttaaagcatgatatagatagaaatggctgacactttttgtattaataatgacatcgtcgtcaatatacgataatacttctcgtatcaatgttaaaaattcgcggtattcattttcgtctaaaggtgtttcactaatatccttaatcaataatttccacttcaaatcatgcataaccatgtattgaagaaacaaaggtattttttgttcattatttttggtgatatcgattaaattcttggagaaagtgataagtgaatggttaaaccaattcttatttgctttagcagtctgcatggcagacgatccatcttctctaactctataatgatattttgcctccttaacaagaccatactttttcttttgcgatataattaaattaactagcttagcatcttcacctattttacaattttcatcaaacctgatatttttcaaggcatcattttttataaatgtagaacagcaatgagttaatatatgatgtggttctttttccacatccaatattctcgttgcagaaaacttattatttagattatgttctccagttcttccttcctcaaaaaatattgggattgctacaatatcaatttcatttttatgttggttaaagaagtttaaaacattttcgaatgtttcttctgaaactaaatcatccggatccaaaaattgaatatatctgccttcagcatactttaaaccataatttcgggcactgctcactccgccattctgtttctttacatatacaatattttttggatatttttgagcatattctttacaaatcatttcacttttatcagggctttcatcattcacaagtattaactgaatattctcgaatcctaaagtctggttaataacgctttctattgcatcagttagatataactcgacattataaatcggcattataacactgaaatcatagttaaaactcttttcgttcataaaagattactcctaacaaaatgtttatatgaataagaatccgggtaaataaaagtaaaaacaattagagtgctaaatttttgaaaacacataattaatttagtaaaatgtataaaaaggattccttacctgttttttaaagtctttgtaagaaaacttttaaatacgtttacatggttaagttctaaagcatcatttggtgtttttaggacaaagtcaaatgcaagggcccaaatcggtatttctacaacaaaaccagcatgtctaaaatctcttaatttatatccccatacttcaattgtttttttcagttcttttcgtttacatacttttaatctattaaaatattttatatataatctgtcattttctttcatctcataatactggttaataaagtgccctgttaattcaagcctaaacccttttatttttgtcgaagtaacagtacatgaactaagcagtactctttctttttttatattttcaagagcttctgtattttcttttaataagtgaaacataaattctttatagtacatcggcatatcttgttcttttataaattgcggatcaataaattttaaaacttttataaaattatcaacaaaaactttttgttcttgttgatctaaaacagacttataaacatctctatagttcggatataaaaacaatttcatatgatatacaattaaaaattgcagataaggcaaaactatatcatatttttctattgaatccatcaacaaagtcatgtaacattcattcaacaaatatgtgtacctttttttgttaaaccacgaacgatcaactaacgagttctgttctttccgttttctataaaaatactttccttctgcaactgctccgtatcttttttctttcagtaataactgattaaaaaagatagcgtcttcccaaaactttatagattcatcaaactggacggtacgatttagtgtatgtcttctgtaaaaagtgccgccaatataaaagtgaatagctttataatcgttgagaatatttataactcttgttcctttttcaaatctattatttaatttatgttcgccttctttttcacctgtgtaataaacaggtaataccgcgatatttacatcttcggaatcacaaaaaaaatcataaacactttgcagtgcattatgagacaatgcatcgtcagaatcaagaaaaccaataaatttagatttttcgcttacatttgataatccacaatttcttgcagcagagggtccagagttttcaattttcatgattttaatattattaggatatagatttttaaaggactcacaaatttgaggactgctatcaacactgccatcatctattaatatcagttctatattttccttaaatcctattgactggttaatgacactctctattgagtaccttaaataattctcagaattatatattggcataattatagaaaacatgtttgtacctctttatttagaagttaaaggatcgtttcaattactcttttagaagccttgccatcttctaaattacaaaattcattataaaaatcctcatagttatgatctatataaggattatgtaacaactctattaccgtatctataagttcttcacttgtttgaaccaagtttcctggcgttttttgctgaaaattaaaataaaaacctctgatagagtctcgataagccgggagatcatacacaaaaaatacgatgggtttttttaaattcatataatcaaaaaagacagaagaataatccgtaatcaataaatcactaattaaatataaatctcgaatatctttatataaggaaacatctttcacaaaatctttatatttccctaaattaaattgttctgaaactagataatgcattcttaaaagaataaccacagagtccccaagcttcctcttcatttcctctaaatcaaattgaagtttaaatttatactgaccaactttcttaaactcattgtctctccaagttggtgcatataaaattatttttttatcttcgctaatttctaactcttgttttaccctatttattaatgattctttatttggtgaatatagaatgtcatttcgcggataacctgtttctaaaatttgttttttaaattgaaatgcccgtttaaaaatttcagtcgaataagcattaggagaaatcaaataatcccatttgcttgcttcctgcagaaaattctgtttatatttttcagttgtggttccgggcatatgcacttcatccatatcattagcaagtttttttagcggagtgccgtgccacgtctgtacatacaatgtgttttttggttttggaatccataaagggagccggctgtttgtaatccaatatttcgctgtagccatgtaccaaatccacttaaaagaaaacctttttatatatgctgcatctacgccgtctaatgccgacaaatatcgtttatcaatgctccatatcattttataatcatattgatctttattttcctgtaaatattcatagattgctcggggattgcagctaaactgttttcctgagtagctttcaaataaaattaatttattgtttcttggcagaagagcaaaaatcttaaaaagaactgaataggccctgactaataaacttctgcatttttgtaaaataaaagatttcataatgaactccttaaagagtaaaaaatttatatttgcgcaaacaagaaaaaaagaagcaactgaattacttcaagcctctttaagttagtgcttctataaactagccatgtcttttttgatttgggtagttgaaatgccttctgttctcggaaggtaaatgacctcacaatattcctttaagaagtcaaatttccctttccaatcatcgccgatcacaaatgtatctatatcgtacttttgaatatctgaaattttttgttcccagtttttttcgggaatcacttcatccacaaaatcaattgtttctaaaatgaattttcgatgttcataggaatgatgcgattttttttgtttttgaagattaaattcatctgtagataatcccacgattaagtaatcacccagattttttgctctttgcagcagcttcatgtgtccataatgaaataaatcaaatgttccgtacgttatcactttcttcatcagataacatcaccttccaactgttttcaactgagagtaccagaaaaaaaccacaaaccttaacagattgtttataatttcgacacattttttacgtaccattaatattgaacaataatagcataagttcctataaaagttaaggctctttaaaaatgtcaatcaccagcattttttggtatcatcgttgtattgatgtataatttttacaggtctaatgccttatccatacccattataacaagttttctttttcgaaaaaatcgaatcttttgtcgcgtttttaagtgaaacgattttctttctgctgcgtcatttattttgtacgcccctcctcatattaattcatcgtcaaaacgtgaaggaattgtaatgtgaatgttaaaagttcctaaagatttttgtggtaagatagagtaaaatgttttcagacaaagagtctttaatcaaactatacgaatgacacgtgttttttatagacatatagatgaaaaggagggttgatacgatgcaaacgaaacccattaatcaattagattttgtagacggtgaactgacttcatttgtatcacatttagaaacgtcatttttggaccagaataaaggtgcgttcatcgtaacagcgaatcctgaaatcggatttgaagcgatgcaaaatccgcgttatgaagcggttctttcatctgctgattttattttgccggatggcattggtgttgtgttggtttccaagctaattggtaagccgcttcaatccagaatcgccggttatgatttgtttacatctttgcttgagaaggctgatcaaaagaaaaaacgggttttcttttacggtgcagctaagcatgtgattgctcagacaatcgagcgagtcgaacgtgattatcctgggattgaaattgccggatattctgacggttatgtgaagaatcaacatgaggtggcagacaagatcgcagcctcaaatcctgacatggtatttgttgctttaggttatcctaatcaggagttctttatccataaataccgacatctattccctcaggctgtttctgtagggctgggcggaagctttgatgtgttcagcggcaatgtcaaaagagcgccctcattttttatccgttttcaccttgaatggatgtacaggctgatcacaaaccctgcgcgctggagaagaatgcttagcattcctaagtatgttacagccgtgctgaaacatgaacgaacttcagcaaagccgcaatatacgggacaggtcaaagatcaatcacgccatctgtaatgggccttaaaggagctatggtatgtaatgaaatgcatgaatctttcgctgtgcctgccgacaatccgcggcagccgttttgagctgatgacagattgaaatcctggtttgcgtttttttactatttgttcatcaaagtcatcggcgcattgctgttttgggtcaaaccgggaagtcaagtgacccttcttgtttcctttcctgataatgcccgggcaatattaaaggaatatcagatgggacactactcatttcccattcatgtacttctgacccagcatgccaaatcgctggaaacagaatttcctgagcttactgtttcagttattaacgaaaaacacccgcttcatatatataaagcggtcttttctatgctgagcagtaaagctgtgattgttgataactattttgttttgacaaccgttttgacctgcaggcctgatatcgagtgtatccaagtttggcatgcgaatggagcgtttaaacgatttggattaaaggatatcaacacacagaatcgttcgcgggctgacgtgagacgatttcgcaaagtgtatgcttcatttgaccggattgtcgtcggttctgaacatatggctgacatattcaaggaattcttcgatataaaaggtgataaatttcttcggtttggcgtgcctttaaccgatgcttactatgaggtgaaggaaaacagcaatgaccttaaaagcaaatatcacctgccggcagagaaaaaaatcatcctgtatgcgccaacctttagggatcatcagtttgaaagcttttcgctgccgttttcagaaaaacagctgcagcatgatttaaaaggagaatatttacttgcagtaaaacttcatcctgttatgaagcaatctgctcaattacatggggatagtgcgtggataaaagacgtatcagatctcccgcttgcagaccttttaaaaatgagtgatctgttaatatcagattattcttctgtcccttttgaatttgctttgctggacaaacccattttgttttatacgtatgatatggaggcttacaacagaacccgcggtttaatccgccattatacagaggtactccccggggttccttgccgtgattcaggaatgctcttggaccagctgaaagatatgaacaggcttcaaactgaagtggagcgcttttcacgtgaatggaatctgtactcaagagggaatgccagcaagctgcttttaagctatgtaaatgagaaatcaaactgatctttatatataatagagatcggtattgcaaataatatgaaaaccttttataaaacattatgagttgtagtaaggaaggagtcattttatgatttatgctgagattctagccggtggaaaaggttcccgcatggggaacgtcaatatgccaaaacagtttttgccgttaaataaacgcccaattattattcatacggttgaaaagtttttattaaatgaccgtttcgataagattttaatcgtctcccctaaagagtggattaaccatacaaaagacattttaaagaaattcatcgggcaggatgatcgcctgattgtcgttgaaggcggcagcgaccgtaatgaatctattatgagcggcatccgctatattgaaaaagaattcggtattcaggatgatgacgtgatcatcactcacgattctgtgcgtccgtttctcactcatcgcattatcgatgaaaacattgatgctgttcttcaatacggcgcggttgatactgttatctcagccattgatacaattattgcttcagaagaccaggaatttatttctgatatccctgtccgcgataacatgtatcaggggcaaacaccgcaaagcttccgaatcagcaaattggtcgagctttataatcaactgtccgatgagcaaaaagctgtccttactgacgcttgcaagatctgctcgttagcgggtgaaaaagtgaagctggtccgcggtgaagtctttaacattaaagtaacgacaccatatgacttaaaagtggctaatgccattttacaggagcgaatttcacaatgattaatcaaacatatcgtttagtttctgcccgacaatttgaagtgacatataaagataaagttgtccattcagataaggtcgtcgtccgtcctacccatttatccatctgtgctgcagaccagcgttattatactggctcacgcggcaaagaagcgatggacaaaaagctgccgatggctctgatccatgaagggatcggaaaagtcatgtttgatccgacaggcacatttaaagtcggaacccgggttgttatggtgccaaatacaccggttgaagagcatgaagtcatcgcggagaattacctgcggtccagcagattccgttcaagcggttatgatggatttatgcaggattatatgttcatggcgcctgatcggcttgttgagcttccagacagcattaatccgcatgtcgcagccttcactgagcttattacaattgcagttcacgcgctttcccgctttgagcgcatggcgcataagaagcgtgacacattcggtgtctggggggacggaaatctcggatttatcatgacgcttctactgaagaaaaaatatccagacagcaaggtgtttattttcggaaaaacaccttacaagcttgatcatttttcttttgttgatgcagcttatcaaattaacgacattcctgaagatgtcagaatcgatcatgcctttgaatgcgtgggcggacgaggcagtgaaagcgcaattgagcaaatcattgcccatgtccatcctgaagcgtgtgtagcgctcttaggcgtatctgaataccctgttgaaattgaaacaagaatggtgcttgaaaaagggattacgctgatcggcagcagccgcagcggacgcgaggattttgcccgtactgtagactttttagctcaataccctgaagtcgttgattatttagaaacattagttggcggacgcttcccggtacgcagtattgaggaaattacaaacgcgtttgaagcagatttgacttcatcttggggaaaaactgttattgaatgggaaatttaaacagtgaaaacattccttacgcgaattgtaaaaggagtattcggtactgcttataaactattgagcgctttattaccagtacagcacaacaaaattgtcatagcttcctatcgtgaggatcatttaagtgataattttaaaggtgtctatgaaaagctgaagcaagacccgtctcttcgcatcaccctgctgttccgcaagatggataaggggctgatcggacgagctgcatatttgcttcatcttttcagctcgttatatcaccttgcaacatgccgcgtgcttttgttggatgattattattttcctttgtatgttgtgccaaaacgaaaggaaactgttgccatccagctttggcatgcttgcggcgcgtttaaaaaatttggctatagcattgtgaacaagccgttcggcccttcttctgattatttgaagattgttcccgtgcattcaaactatgattatgccattgtcagtgcacccgctgccgttccgcatttcgccgaagcctttcaaatggagcaaaagcagattttgccgctcggcattccaagaacggattacttttatcataaggaacatattcgcactgtactggatgagtttcatcgggtttatcctgaactgaagcataaaaaaaagcttttgtatgctcctacttttcgaggcagcggacatcatcaagagggtgacgctataccgcttgatctgctacaattaaaatcggcgctaaaccataaagattatgtcgtgatcctccatcttcatccgtatatgcgcaaacatgcgcacacggaagaggatgattttgtgctggatttaactgattcgtactctttgtacgatttgatggcaatctctgatgggctgataaccgattattcttcagttattttcgagtacagcctgctgaaacgtccgatgtatttttactgcccggatttagaagactacttggaagaacgtgatttctactacccgtttgaatcgtttgtacccgggccgatttcgaaagacgttccatcgcttgtacacaatatcgagagtgatcacgaggctgatacgaaacgtattgaagatttttcacaggcatttatcacccatcaggacggcaaatcttcagagcgggtggccgattttatttcatcatttttaacatctggtgccgattaggagaaagtgaggtacaaagtgaagctggcaagaaagattaagaacagacttttcagatcaaaaaagaaaacgcaaaaagaaaatgcagctatcattgtccatccagctgataacagggttttttctctttttgataaaacgaagcgaattgaagaaaaccagcaagtccctgtcagaaagatttctgagttttcttggaatgggtcaattctaaaaattgcgggttatatgtatatcaagggcctgccgcttcaaaaagaggatcaggttcgaaaacgtttattattggtgaacaacggtgttttgtttacagctgtttcactgcgggatgttccggtagataagctgtcaattgatacttcaaatgtgcctggagcctataagtgggcaggattttcacagcagattaacttttctaagctgatgaatgacaagcctcttccgcagggcgaatataagctgtttctcgagattgaagctgtagatgaccaaaatgtaaaacatcaggaagtgcacacagttggaaatgtcagtaatttcctctctaatgatgtgtatgccacaaaaatggaatttcattctgctaaaaagctgatgaagttcaatttgatcgttaattatgatgagggcgaaaagacgattaatttgtcttgcaacaaactgcaggaaattgatccgagccttttggagctggatactggaaaagaggcaaaccgctttttgcgcaagctgaatacaagcttattccattttgcttatgatgtattccgcctgcttccaattaagtctaataaaattgtctttgcttctgacagccggcttgatatgacaggaaacttcgaatttgtttatgaagagctgctgaaacgtgaagaaaattttgatttcaaatttttcttaaagagcagcattcgagatagaaaaagcctgtctgaactgatgtcgatggcttatcattttgcgacaagcaaaatcatttttatagatgatttttatccgattatttatccgttaaaaatccgtaaaaatgcggaccttgtccagctgtggcatgctgtcggcgcctttaagacattcggctacagccgaatcggtctgccgggaggaccgtcaccgcattcgaaaaaccatagaaactacacgaaggttattgtcagctctgaaaatatacggaagcactacgcagagggctttggggtagacattgagaacgtcattgctacgggcgtaccgcgaacagactttttctttgatgaagcgaagaaggcatttgtaaaagaacgcctttacacggaatatccgtttctaaaggacaaaaaggtcattctttttgctccaaccttccgcggaaacggtcagcaatcagctcattatccttttgaagtgcttgattttgaccgtctgtatcgagagttaaaggatgaatatatcttcttattcaaaattcatccattcgtacgaaacgatgccaatataccttatcagtacagcgatttcttttatgatttctcttcgttcagggaaattaacgagctattgctcgtaacagatattctgataacggattactcttctgtttgctttgagtatgctttattaaataaaccaatgatcttcttcagctatgatgtagatgattatattcgcaaacgtgatttctattacgattactttgactttattcctggccctcttgcgaaaacgtctgagcaaatgatttcgatcattaaagaagagaagtataactttgagcaaattgattcatttgttcattatttcttcgatgatcttgatggaaaagcaagtgagcgagtcgtcgatcaaattgttttccctcaggaagaagagccatcagaggataaagttcttaaaagataaatcaaaaacaccttttgcagccgcaaaaggtgttttttttattgatattccggaacatcaaaataaagtgtatagccgtccagcaatgaatacaggctgtacatgcggtttacttgtttgtacgcccagccgatgtctgttgcgtattgatgtgtcgctgtagctgaccatctcattttgtacagtgtatcctgattgtaagctgtgttgtggatatacgatgagcctatgaatttagctccgccgataatggccgcttcaggtgtgaaccagccctgctcgtacgcatatttggctccgtagtaattcggattgctgtcgtatgctccaattccatacatgttgtatacggtttttccgttataggttaatccattggctaaagcggatgtcccgtttcctgtttccagaagagcgtgtgagattaaatacagttcgttgatgctatattgattggcggcatcgataaatgcctttgctctccctgtcaggatgcctttacccgcaagcactttctgattgacctcagtaacgctgagacccgctgtctgtgacagcttgagaaattggaagtagtatttgctgtctctggaaaagttattcggatccacgtattgaactacttcatcactgcttgcgtttcgccagcccaaattgatcttagcccagccgtttatctgtccgatgactttcactttatcgccttttttaaactggccgatcacgtttgtcgggctgacttccggcgttgaccggatatttagtacatcagccgtaacggttgatgttgctgtattaatgtacgtgagcgatacgtaagccgctccgtctgtttgcggacttactgtcatttgtttttggaccatatcacgaagcgagagattgtagtttgttttcatgatttgcgggccgtttttgatcttcacgatagatgatgtccatccgtataattgttttagcttcaatgatgccgcagcagctgtatcattgcctgtgaactgctcatttacgctgattttataaagcgtattgcttttcgatgtgtagctgggggttacacttttcgatttaagataggttaacccattgttcaatgctgttttgctgctgagctgtgttgtcacgattttgtattgtgtatatgcagtctggcctgtttttgatgttgtgactgcgattttattttgtttgaaaaatgttaaaacgcggtcaatctcttcttggctgatgatagcttcagttgtgatttgatagctgctcgcagctgtctgaccggttttctggcttgctgctgatatatgattcgatttgaaaaacgtgagtgcctgattgactttcgtttgatcaagcagagattcggttgtgattttaaacgtgtcagctatttgttttttgacggatttcgcagaagcactcagctgatttttctttaatatgttcaagccctttgtgacttttgcttgatctgatgtttcttctgagatgagctgatattgattttctgctgttgatccagctgctgtttttgcagcttttacttttttctgagcaaagaaggctgctgctttgtttgcttgctgctcgcctaaaatctttgccgtcgtgatttgataagctgcagacgttgtcgtttttttgacgctggatgacgtgtaatgccattttttctttttaaagaaagtgtctattttttggagctgctgttttgttatacccttcatattcacggtatatgatgtgctttttccaacctgttgataactgccggatacgccagtgtttttcttgatttggctgatggcgtcctttactgtattcagccctttgaaataagctgattggacattgtatgactcaacggttgttttttgattgatggacttgtagctgcctgtgatgccagtgctctgtttcagctgctgcaatagagttttggcattcgcttcacctgaaatagcggcagttgtgaacgtataataggcttgtcctttcaccgtttcctttaatgatgcatgcagcccggattccttttggaaggcgtttttgatctgcgctgctctgctgtctcccacgattgtgccagactgaatggttgtgacagacaccgtgtgtgtgatgggctgatacgagcttttaatccctgtttgcttagccaggctctggataagcgccttgacttttgtctcatcagcaatgtctgatgtcatgacgttcatatagggccgagctgctccgtaagcttttacagcgccagccactcccgtctcctgtttcagctttgctagggtagtgttggcctgtttttctccggagatggcacctgacgagatggtgacatatggctgtttgcttccaacaggacttgacgttcctgtaatcgatgtctgtttggcgagtccgctcagtattgctttcgcttctgattcgctatgaatgcctgaggcggaaatttggtaggtcgttgttgtgcctgaagcctgataggatgcatcccagccagtatctttttccagtttggcgacagcttgtgaggcttggctttctgtactgaacgtattcgacggctctactttatatagtgagtagtcggtatacgcggctgcctgggcagaaccagatatggcaaaaaaggcaagggacgcggcggatagaagcataggtgcgattagtctcattttcattccttctcctctttcttattctatgagtatataaaactagtttatttatcggcacgcgcatgcttcatttataggtgaatcacttccattttctaataaaaaaaacttaatctcgaagtgagattaagtttaaatatgagacacgataagggtacaagttccttttatcgtaaaatcgggcatttgagccggcaaaataaagtgatcaccttttttgagcggacatgttttgtcctcatacttgagcaaaccgcttccttctatcacgctgcaaatcagaaaggattcatcctgagccatttcagcttcgccattgatgtcccatttatacaccgaaaaatattccccttgaacaaacgttttaatggttatgccttttcttgattcggtcgattcatctatatacccgtccacatggggaaccgtggcggcattgaccgctttggcaaaatgaagctctctcggacttccgttgctatcaagacggtcataatcgtacacccggtatgtggcatctgaattttgctgagtctctaaaacaagggcccccttgcacaatgcgtgcagcgttccgctcggcacataatagaaatcacccggtttaattttgattcttcgcagcaggccctcccagtcaccgctgttgatcattgtgacaagttcggtttttgagcgggccgtatgcccgtaaatgatttctgcgttttccttacagtcgataatgtaccagcattccgtcttgccgagttctccctcttcgttttctccggcatagtaatcatcagggtgaactttaattgacgtatcttccttcacatccagcagctttgtcagaagcggaaaccgatccccctctacgccgccgaatacttcacggtgctcttcccaaagctcgatcaatgtctttcctttatacgggccatttgcaacagtgctcggtccttttggatgagcggaaatgacccagcattcccccgttgattctgaaggaatactgtatccaaatctatctcgtaaagcggttccgccccagattttttctttaaacacaggcgttagaaaaatcggtgattgcgtcatgatccgtacccctcccctgtaaataactgatcatcattttcccggtgcgcccctcttacaaacgcccgtataagctgcctttttccgatgacaacatatgtacaaagcatcatcttttcattaccccttcaaagaaaacgcttcctatctattatatcacgtcgaaaagaagctttgtttcagccttttcctcgataagaataattctccttttttgatacaaattaataaaaaccgtcaactgtttacgaaggagagaaactatgcaaatcgactctgatctccagaacaatttagacacactgaaaaaaacattgggacaaaacgacgatatgatgttttatacatttgctttcggagatagcagacaaaaggcgtgtttactgtatattgacggtctgacagagaataaaatgctggcgcaatacgtcatttctcctttacaaaaagaggcgttggcccataaggaatgctcgattgaagacttatccgccttttttttcggctttcaccacagcgttgtttctacaatgaaagaaatagagcagctcgttttttcagggcaagccattttgctcgctgatggctatcgcggaggattagctttcgacacaaagtcagtcgcaacacgcagtcttgatgaaccctcctccgaagtcgtggaacgcggccctaaaataggatttattgaaaagctgcggacaaacacggcgcttttgcgtgaacggacgagtgatcctaatctcgtcatcaaagaaatgacactcggaaaaaggaccaaaaagaaaatcgctgtcgcttatattcaggatatcgccccagattatgtcgtcaaagaagtgtttaaaaggctgaaatcagtcaatatagataatttgccggaatcggggacgcttgaacagctgattgaagacgaaccattttcaattttccccacaatattaagcacagaacgaccggaccgggtcgaaagttctctattagaagggcgagtgtccatattagtggatggtacgccgtttgctttgattgtaccggctacggttgacgaatttattcattcgcccgatgattacagccagcgctggatcccaatgtcacttgtacgccttcttcgttattccagcatcctgatcaccatttatttgcccggtctgtatatttctctcgtttcttttcacaccgggctattgccgactagaatggccatttccattgcaggcagcaggcttaacgtaccattcccgccttttgtagaggcctttatcatgatctttacgatcgaattgattcgagaagccggattaaggctgcctaagccgattggacagacaattggccttatcggcggcgttgtcatcggacaggcagctgttcaggcgcaaattgtcagtgcgcttatggtcattgtcgtttctgtcacagcactggcatcctttaccgttccttcatacgcctataactttccgctgcggatcattcggatcggggttatgataagtgcaacagcgcttggcatgtacggcgttataatggtttatctgtttgtgatcggccatctcatgcgcctgaaaagctttggccaggattacattatcccgatcatggcgcagcctggacaggatttgaaagacacagtcatccgtattcccacgatgtttttaaaaagaagaccgacacgaaacgatcccgaagataacatcagacaaaggtgatggctatgaggaaatcagagcataaactgacatttatgcagacgctcattatgatcagcagcacattgattggtgccggggtgctgacccttccccgctcagccgccgaaaccggcagtccgagcggatggctaatgatactgctccagggcgttatttttattatcatcgttctgctttttttgccttttcttcaaaaaaacagcggaaaaactctttttaagctcaataacattgtagctggaaaattcatcggctttctattgaatttatatatctgtctatatttcattggaattgtttgctttcaagctcggattttgggagaagttgtcggattctttttgttgaaaaacaccccaatggcagttgtggtgtttatatttcttgcagttgccatctatcatgtaggcggaggcgtttattcaattgcaaaagtatacgcttatatttttcctataacccttattatttttatgatgcttctgatgttcagctttcgcttgttccagcttgattttatccggccggtatttgaaggaggctatcaaagctttttctctttattcccaaaaacattattatatttctccggatttgaaatcattttttacctggtcccctttatgagagatccaaagcaagtgaaaaaggctgttgctctgggcatcgcgacttccacattgttctacagcattactttgctcattgtgattggctgtatgactgtggctgaggcaaaaacggtgacatggccgaccatttcccttattcacgcattagaggttccgggtatttttattgaacgatttgatttgttcttacagctgacctggacagcccagcaatttgcctgtatgctcggatcctttaaaggcgcccatatcgggttaacggaaatctttcatctaaaaaataaaaacaatgcatggctgctgactgcaatgctggctgcgacgtttttcataacgatgtatcccaaggacttgaatgacgtgttttattacgggacacttcttggatatgctttcttaattgtgattacaattccattcttcgtctggtttttaagctggatacagaaaaaaatagggagggggcagctgcaatgaaaacagcatcaaaattctccgtcatgttttttatgctgctggtcctctgcgggtgctgggatgtcaaagatatcgagcaactatccttcgcaagagggctggcgatcgatgagacagatgatcaccagtacaaactgacgtatcaaaaccttcttccccaaagcgaagacagccaagcatccggaaaacccgaatttgtcaatgtgacgtcctacgggaaaacgattcttgaagcagtcagtgatgtatccatcaaggaccctcctgtttatagcgatcatttaaaagtgattcttctgggagaaaaactgatgaggaatcaaaatgtagaccaagtcctcaaccactttatccgggatgatgagctgcggcgaagcagctatttgatggcagccagagggaatgcagctgatgttttcacaaaaggaaaccccaatcagcagcaaccgatgccctccgaaaaactgattgatttgacaactcacagcggatataacggtaagattatgataccgctgcgcatcggaagagcttctgtctactctcagaacgggtacagttatcttattcaaaccgtgaaaaacgaaaagggaaaagccaagtatgacggagcaggcattatcaaaaggggcagcaataaactcgttgggtttctttcagctgatgaaacccaaacactgtcatgggtcatggggacgatccaaggcggtgtcatgccgacgacagataaaggacatccgattacgtttgaaattaaaaagtcgaaaacgaaaattaagcccgtcattgaaaacggaaagcctgtctttcagatttctgttaaaacgaagggcatcctgacagaagaccaaaacccgaatgaagactcctttagcaaaagatatttacacaggctggagaacatttttgcgaaaaagcttgaacgagatgttaagcaggtaatggataaactgcagcacgagtataaaaccgatccggtctttttatcagaccacataaggattcaacaccctgactactggaataaagtaaaagggcattgggatgaaatattttctgagactgattttaagtacgatatttcttttaaaatcattaactttggcacggtgggaaagtaagcaatcaaaagggtgcgcatgatcgcgcacccttttttatgttccgacagtctgctgttttccggccgatcctccctgtccgtttttgtcccgtaaatcctgctcaatttcttcaaggctttttccctttgtctctgtcactttaaatcggacaaataagaacgccatgataccgatcgcggcataaatcaggaataaataactgattccgatcgcttccattaatattggataggttagtgaaacaatcagtgtcccaacatgcaacattaaggtcgaaacaccggtaccgattcctctgacgtgaagggggaacaattcaggaagcatcacccacacaaccggtccccagctgaccgcaaagacaacgataaacacgcctaaacaaatgacggtcgtccatgaggcagccggagtgttatcgaaaaagagatttactaaagcgagaacgattaagctgatcaccattcccgcattcccgaatagcagtaacggctttcttccaattttgtcgatgattttaatcgctactaatgtcatgagaacattgactgtgccgattccgaccgtgcctaaaatcgaagcggaatttccgaatccgacgtttgtaaaggtctttggcgcatagtagatgatcgtattcgttccgataaattgctgcaaaaatgccaatcccaaacctgcaataagcgctgggcgcacccatggatcgaacagctccttcaggccgccttcatcctgcttttccgcttcttttatatcatgtatttcctgatcaatatcttttgtgccacgcaatttttcaagaattttcttcgctttgctttcttcgccatttgtgaacagccagcgcgggctctccggcataaacaaaatgccaatgagcaagagcaatgacggcacagcagccaatccaagcatccagcgccacgcttcggcatcggcaaatatgtaattgacaatgtaagaaagaaggatgccgaccgtgatcatcagctgattcagtgatgacagcgccccgcgtttatgttttggcgccagttcagataaataaagcggcacgatcgtcgtcgatgttccgactgcaagtcccaaaatgatgcgaaacagcaccatgactcccgtattcggggccagcgccacaccaagaccgcctatacaaaacagcagcgcggccgccataattgctttttttcttccgaaacggtcagtcagcttgccggccgctcctgagcccaatatcgccccaaccagcaaggagctgacaacaagaccttctgtaaacgcgtttaagcctaactcctttttcataaataaaatagctccggaaatcactccggtatcatagccatataacgcgcctccaagagctccgaaaaaataaagccatatatttgactgctttttcataaaaatgactccctttctccatcagctgcaatgacattgtctgtgggatttttttagaaatcttttagcctctttttccggccattaaacctttttattttgctgatcataagttttccaatcatttacttgtatttttttcaatgtcgccgaaacattttacctgctgcggcgtccaatataaggtgattcagcacatcatcgttatcaattttcaaaaacaagaacttataaatataggaatatttatcgaaaaatgtctttcgaagagttgccccatggcaaatagaatggtacgcttcaaatattaaagaaacgtgaggtattgatatatggaagaacgatcacaacgcagaaagaaaaagagaaaactaaaaaaatgggtgaaagttgttgccggattaatggcttttttagtcattgcggcaggctctgtcggcgcctatgcttttgtaaagctgaacaatgcttctaaggaagctcatgtcagccttgcacgcggagaacaatctgtaaaacggatcaaagaatttgatcctggaaaagattctttttctgtattgctcttaggaattgatgccagggagaaaaacggcgagaccgtcgatcaggcaagaagtgacgcgaatgtgctggttacatttaatcgaaaagaaaaaacagctaaaatgctgagcattccgcgtgacgcctatgtaaacatcccaggccacgggtatgataaattcacacatgctcacgcttacggcggcgttgacttgactgtgaaaacagttgaagaaatgctggatattcccgtcgattatgtcgtagaaagcaatttcacggcttttgaagacgtcgtaaacgagttaaatggcgtcaaagtaactgtaaaaagcgataaagtcattcagcaaatcaaaaaagatacaaaaggtaaagtcgttcttcaaaaaggaacacatacgcttgatggggaagaagcgctcgcttacgtaagaacacgtaaagccgacagtgaccttttacgcgggcaaagacaaatggaagtgctgagcgccattatagataaatcaaaatcattaagctcaattccggcttatgatgatattgtggatacgatggggcaaaatttaaaaatgaacttatcccttaaagatgccatcggcctgttcccgttcatcacttcattgaaatcagttgagtctattcagctgacgggttatgattatgaacctgccggagtttattatttcaaattgaatcagcaaaagctgcaggaagttaaagaagagctacaaaacgatttaggtgtataatgaacgggatggcgattacgccatcccgttttacatatttccttgttgaaaattatcaaagtaacgtttagccttgatttatatggattatgtttcacaggcaagctgaacatactacacgaagcagcttcatttttaaggaggttcccctacatatgaaatgtattgcgattgatctagacggaacattactgaataaagaaagcgtcatttctgcggaaaacagagaggcgatcaagcgggccgttgatgccggcatcctcgtcaccatttgcacgggaagagcgacatttgatgtaaaagcgctgctggatgacttggacatccctatcattgcagctaatggcggtacgatccacgacacgggttaccgtttgatcagccggacattcatggatcaggaagccggtaaagcgattgctgattacttactttcaaaaaacatttactttgaggtatatacagatgaccatctgctttctccttttgacggcgaagctaagctgcacgcggagcttgacattctaaagagcgcaaacccaaacgagcagacggatgacttgtggcaaggagccatgactcaattcaaacagtttggcattaaaccaatccctcatatcgaatcggtttttgacggcggtgaaaacatttataagcttctttgcttctcctttgatatggacaagctgaaacaagcgaaggaagaactgaagcatcataaaaaactggcgcaaacctcttcaggaaaacatattatcgaaatcctgccggcctcgtcaggaaaaggacgcgcgttaacaaagctggctgacctatacggaattgaaacacaggatatctatgcgatcggcgatagtccaaacgatttgtccatgtttgaagtcgccggacaccgtatcgccatggaaaatgcgattgatgaattaaaagaaaaaagcacctttgtcacaaaaagcaatgacgaaaatggtgtggcctactttatagaccagcttctttcgggacaatatgcataaagaaaagactccagagattggagtctttttcttttattgcacccgtatacttcctgcgtatttatccttccaatatgtgctcgtgttcatattggtgatggtcacgccgtttgataatgtgacatgaacaacttgtccgtttccgatatagatggagggatttaagcttgttgattgaaagaacacaatgtctcccggcttcaggtccgccttctcaatcttagttccggcattgtactggcttgttgcgtatcgaggcagtgaaataccggctgctttctggtagacatattggacaaatccagctgtatcaaatcctgtctcaggtgttactccgccctgtttgtaaggcacttctccgacataaagcgtcgcttcggaaacaatcggattttctttcgggattgtcaggttgtcaaatcggcgaatacccgtcatcttcgatttccagtaatcctctgacaaataggaaatggttactttttctgaccggcttgcctggatgaacctgcctgcgcccgcataaatgcctgcatgtgaaattcccgttttatacgtattgctgaaatagacgacatcaccaggctttatgttctgaggggctaccttctcgcccactgcccactgctgttctgctgatcgcggcagataaatgccgagtgcctgttgaaacacatattgcacaagccccgagcaatcaaagccctctgacggcgtgcttccgccaaacacatatgggacaccgatatatttttcggcctcctgaacgacaggaacatcagccgttgccggatcggcagcgattcttctcgccccgatataagttccgctccaatagctgctttttttgtaattggtgatgataaccccttttgactgtgtactgtgaaccatttggccgtctccgatataaagggcgtcatgtgtcggaacagtgccgttgcttccctctttcttgaaaaacaaaatatcacccggcttcaggttttccggctttacagctgttccgattttatactggtcgtttacagatctcggcagatgaatatcagccttactgaacacatattgtatcaatcctgatggatcgaaaccctctttcggcgtttccgcgccatatttatactgatatccaagcaggttttttgcttcgctgacaatcaattctgatgatgtatcagcttccgcaatctccgcttttgtcataattggaaccaaaaaacaaatgataaccgccacaagcaaaaacttcttccagtttgccagtgtgttcacttttattatctcctcctctttttgcagttttaacatcggtatttttttgaatatgttaagagactttttgatatttttacagaatgaatatgctgagcaaataaaaagagagtgtctcatcagacactctcttttttgaattatttattggcgtttaccggttcttcctgctgctggattttattcatttccatatcaatcttctgtttttcctgatctgtcagctgatcattgaatttaaaagctgacataaacatgaacacgatagctacggcaacaaacggccagatggctttgacaaatttcatctttatcactccgtttatttagattttagtttgtcactatgatcaatatcaaacgtcagttttccgtcttctactttccaagcgaaattagagtctttcgtcagttcgcgaataatggttttctgtttaaggctgtcttttttcacaggtgcaggtgtcgcttcatggatatcgatcggtgtcacttcaaagcggcctgttccatttttcttcaggtgatactgaaccagtgcactgtctcttgttctcgtccagccttggtcaaagacaaagttgccgaggctgtagaaaatgacggttccgttatatacttcaatcggttctaagacgtgcgggtgatggccgacgatgatgtcagctcccgcatcagacatggctcttgcaagctggcgctggcggtcgtttggatcattgtcatactcttggccccagtgtgactgcacaacaacgatgtccgcatgttttttcgcttctgaaatcatagggatgaagatttcaggatctgcgggcagcacgcccggcgtattctttttagctgcgaaacctttcccggacacatcggtaaagccaagcgtcgcaatcgttaccccgttgactttctggtacgaaattttctttttcgcatcacttaagctgtatcccgctccaacgatatcaaggttttgcttcgcaaattctccaagcgtatctttcatgccctgaacgccgtaatccattgcgtggttgtttgcgctgttgagaaccgtgaaattcatatccttcaagactttcactgattccttattcgtctgcagatgaatctctttatctgcttgtttataattcttttgataggttaccgggttttcaaagtttcctgctacataatccgaagctctaaagatcggttcaacatattgaaaaatactgtctgcccctttttgctccgttactttttcaacatagcgtcccatcataatatcgcctacaaatgaggctgagagtacgtcgtcagaatacgttttgaccttcggcgtttccgcttttcccgcccacatgaaagcgaacataaggacaaaaacgatcggaatggcaataaatacgtgcttattggttttctttttttgctgttttgtcagctttagcagcttttcatgaaagctcagttcttttttcatcgtttgacacaccttacattaaattaagtagtaaacaaacatgatagcaaaggtcgctccgctcaatagcagcgtgcttccgaacgtaatggttaaaccttgtttctgaatggtattggcaattaaacctggcacgatgatgccgattcctcgaaattctgcgatttcaaatggtacaatcgggtatagaaaatcaaacgcgatttttaggacgatccctgttatcagcatggcagcgaattttctgcgtccgtacaaaatcataaatttggataaaccgtatttcacgataacataagtgagcaagctcactagcaaaacaagtaaaataaagaccggctgattaaacacaagtcctaaatatcccggtacaacaagtcctgccggcacgatccctgttttttccgcaaaaattaaactgagtagtacacctaaaattagtgcgatgtataaatctgatccgaacatgtttgcatttccccctagcttacgagctgcttaaccttgtattcgtggattttttcaattaaaggctctgcggcaccatgaatattgccgacgccatatatgacacggttgtgcattcttttctttaacaactccataatttcatctgttgacttatactctagatcatgcagtttgtctgcaggaattttgccttcttcgtaggcttttacgatcggttctgttgtttcaccgattaagatcagttcacttgcttcaatataaggcaatacgtcatttgcgaattgctgtgtccgatcgacacggtctgcgcggcagttcatgatgatgatcggatcatcggtcgggtaaccgatttcttttacacgtttccatatattcaaagtagaagaagcgtcgtttgcggcaaacccattaacaaagtgcccaggctcgctcggactgatcagcggaagaattctcattgctcccggatctggcggcgcattcagcattcccttaaatgctgtttcttcgtcaatgccgagtgcttgagccacacccagcgccagagaagcgttatcagggaataccatgtattcaaatttacgtaaatactcatctgtaatttttgagttatcagcaatgatgacttttgtgtttcgttcttttgctttttgtttaaagaactcggtatattcactatctgtaatgacaagatggccattataaggaattgtagcggtaaacgcttctgcaatttcatcaagcgtcggccccatgacatccatatggtcttctaaaacattcacaatgacgccgatattggcctgcagaagttcttcctgaaagatgatttgataatctgggttaacagccatgcattcactgacaatcgcgttagcccctctttctactgtttctctcatgacttctttttgctctccgatattcggcccctgaggtttccgtttaatcggcttttcctccggtgtgtcccagtaaatcattcttgcatctgttcctgttgtttttccaacagtcttgtaaccggcttctattaatattccggttgtcagccttgtcacagtcgattttccgcggatgccgttaatattcacccgaacagggagggcatcaatgtttttctgatgtcgtcgtttttctaatattccgatgaccagtatgacagcacaggctataatgagtaaccacattgcttttcgacatctccttctatattgttgtaaattcattcatcagtatatagaatcactatgaattctcaatcggcattatgtaacataatcttccctaatcgactaagccaaacttctcttttgaaagagattttatacctacaaactgttttctatttttggaaaacagcaggacttataccttatcacttttttaaaaaattgaagagaatgcgctttcatttttcccctgatatccttctggacgtatagtcacaccctggtgtttgtatttaatatgcatttcaaatcaatctttttttcagcctgtgttatctagcatttcctgctatcatgcgtgtttccggttcttatgaacacaaaataattttatcctgtttcttaaggacaaggtcataatgtcatcctttctgcatggaataagcaatattaggcccattccaaaatgactaaggaggttcgagatgaaaacgctaaacatatgagtccgaattctctaacataattaaacattttctgggatgatagtcttttctgtttctcaccatttacaggtctaaacgcatgactttgaaacaattttaataaaacttaatatttgttcaagaaatcttcatccatatttgtgaagactttgtcaaaaaaagagtgaaaaccttaaatttttcaattatatatacaatttacaattagatttcttttgatatttttattgctaacttcggattgttcatgataatctatctatgtaaacggttacataaacaaggaggagctgttttggctacaattaaagatgtcgccggagcggcgggcgtttcagttgcgacggtttcccgcgtcctgaatgataacggctatgtacacgaagaaacgcgaacgcgtgtcatagcggcgatggcgaagctgaactattacccgaatgaagtcgccagatctctttataaaagagaatcccgactgatcggacttttgctcccggatatcacaaaccctttcttccctcagcttgcccgcggtgcggaggatgaattgaaccgggaaggctatcgccttattttcggcaacagtgacgaggaattgaaaaaagaacttgaataccttcaaacctttaagcaaaatcatgtcgcaggcattattgccgcaacgaattacccggatctcgaggaatacagcggcatgaattatccagttgtttttctggacagaacacttgaaggggctccttctgtgtccagtgacggctatacaggaggaaagttagccgcccaggctatcattcacggaaaaagccagcgcattacgctcttgagaggacccgctcacctgccgactgctcaagaccgctttaatggcgctttggaaatcttaaagcaggctgaagttgagtttcaggtcattgagaccgcttcattttctattaaagatgcacaatcgatggcgaaggagctgtttgccgcttatccagcgacagatggtgtgatcgcgagtaatgatattcaagccgctgccgttttacatgaagcattgcggcgcggaaaaaacgtgccggaggacattcaaattatcggctatgatgacattccgcaaagcggacttctgttcccgccactttctacaattaaacagcccgcatatgatatggggaaagaagctgccaaactgcttttgggtatcatcaaaaaacagccgctggcagaaacggcaattcaaatgcctgtcacctatataggaagaaagacgacaagaaaggaagattaagatgcgtaatatttgcgtgattggtagctgttctatggatttagtggtcacctcggacaaacgcccaaaagccggtgaaacggttcttggcacgtcatttcagactgtgccgggcggcaaaggagcaaatcaggccgttgccgcagccagacttggggcgcaagtgtttatggtcggcaaggttggagacgatcattatggaacagctattttgaataatctcaaagctaacggcgttcgcactgactatatggaaccggttacacatacggaaagcggaaccgctcatattgtgcttgctgaaggcgacaacagcattgtcgttgtcaaaggcgcgaacgatgacatcaccccagcgtatgcgttaaacgcgctcgaacagattgaaaaggtcgatatagtgctgattcagcaggaaatcccagaagaaacggttgatgaggtgtgcaaatactgccattctcacgatatcccgatcatactaaacccagcaccggcccgcccgctcaagcaggaaacaattgatcacgctacctatctgacgccgaatgaacacgaggcttcgattttattccctgatcttaccatttctgaagctcttgcgctttatccggcaaagctctttattacggaaggaaaacaaggcgtccgctattcggctggcagcaaagaggtgcccatcccgtccttccctgtagagcccgttgatacaaccggagccggtgatacgtttaacgcagcatttgccgtggccctggctgagggaaaagacattgaagccgcattacggtttgccaatcgtgccgcttccctttctgtctgctccttcggtgcccaaggcggaatgccgacaagaaataaagtagaggagctgctgtcatgaaaaaacacggtatactgaacagccatcttgccaagattttagccgaccttggccacactgataaaattgtcatcgcggatgccggactgccggttcctgacggcgttttgaaaattgatctttcactgaagccgggccttccggctttccaagatacagcggcagtgctcgctgacgagatggtcatcgaaaaagtcattgctgcagctgacataaaagcatccaatcaggagaatgcgaaatttctagaaaatcttttctctgaacaagagattgaatacctttctcacaaggagtttaagctgctgacaaaagaagcaaaggcagtcataagaacaggagaattcacaccatatgccaactgcatcctgcaggcgggtgtgcttttctagaaaggaggaggaaacatgcagattgaaatgaaagacattcataaagcattcggaaaaaaccaggtgctgtcaggcgtttcctttcagctcatgcctggcgaggttcacgcattaatgggagaaaacggcgccggcaagtccacgcttatgaacattttgacaggcctgcccaaagcagataaaggtcaaatcagcataaacggaaacgaaacgtatttttccaatccgaaagaagcggaacagcatggaatagcctttatccatcaggaattgaatatctggccggaaatgaccgttcttgagaatctatttataggtaaggaaatatcctccaagctgggcgttttacaaacaagaaaaatgaaagcgctagcaaaagagcaatttgacaaactctccgtctctctttctcttgatcaagaagccggcgaatgttccgtcggacagcagcaaatgatcgaaatcgcaaaagcgcttatgacaaatgccgaggtcatcattatggatgaaccgaccgcagcgttgactgaacgtgaaatcagcaagctctttgaggtcattacagcgttaaaaaagaacggcgtctccattgtctatatttcgcatcgcatggaagaaatttttgcgatttgcgacagaattaccatcatgcgtgacggaaaaacggtagatacaacaaacatctcagaaactgattttgatgaagtcgtcaaaaaaatggtcggacgggagctgactgaacgatatccaaaacgcactccttctctcggtgacaaagtattcgaggtgaaaaatgcctccgtaaaagggagttttgaggatgtcagcttttatgttcgttccggtgagatcgtcggtgtttcaggattaatgggagccggccggacagaaatgatgagagcgctgttcggcgttgacaggctggacacgggtgagatatggatcgctgggaaaaaaacggctattaagaacccgcaggaagccgtgaaaaaaggtctcggctttattacagagaatcgcaaggatgaagggctcctgctcgacacctcgatccgcgaaaatattgccctgcccaatctgtccagcttctcaccaaagggtctcattgatcataagcgggaggctgaatttgtcgatctgttaatcaagcgcctcactatcaaaacagcatcaccggaaacgcacgcacgccatttatcaggaggaaaccagcaaaaagtggtgatagccaagtggatcggcatcggaccgaaagtgcttatcttggatgagccaaccagaggtgtggatgttggcgccaaacgagagatttatacgctgatgaatgagctgaccgaacgcggcgtcgctatcatcatggtgtcatcagagcttcctgaaattctgggaatgagcgatcggattatcgttgtccatgaaggcagaatcagcggagagatccatgcgcgagaagcaacacaagaacgaattatgacacttgccacgggagggcggtaatatgaaaacagaacaaaaacggattcacttcgacggagtcatgcaaaaactcggcccgtttcttggtttatttattctcgttatcattgtatctattttaaatcccagctttcttgaaccgctgaatattttaaacctgcttcgccaggtcgccattaacggattaatcgcgttcgggatgacctttgtcattttgacaggcggcattgatctttctgttggcgctattcttgccctgtccagtgctttagttgcggggatgattgtgtccggtgtcgatccggttctcgcgatcatccttggctgtatcattggtgccgtactaggcatgatcaacggattattgattactaaaggaaaaatggcgccctttatcgccacgcttgcgaccatgactgtgtttcgcggactgacgctagtgtatacagatggaaatccgattaccggacttggcacaaactacgcttttcagatgttcggacgcggttactttttaggcattcctgtaccggcaattacgatggttcttgcctttgtcatcctttgggtgcttcttcataaaacaccattcggacgccgaacgtacgctatcggcggcaacgaaaaagccgcgctcatttcaggcatcaaagtgacgcgcgtgaaagtgatgatctattctttagccgggcttttatccgctcttggaggtgccatattgacttcccgcctgcattcggcccagccgactgcgggagaatcgtacgaacttgatgctatcgcggcagtcgtcttaggagggacaagtctttctggcggccgcggacgcattgtcggcactttgatcggggtcctgatcatcggcacacttaataacgggcttaatctgcttggcgtttcatcattttatcagctggttgtcaaagggattgttatcttaattgcggtattattagaccgcaagaagtcagcttaggagggttttcacatgaaaaaggctgtatccgtcattttaacgttatcattatttttgttaaccgcctgttcgcttgagcctccccaatgggcaaagccgtcaaactcggggaacaaaaaggaattcaccattggcttgtccgtctcaacacttaataatcctttttttgtctcattaaaaaagggtatcgaaaaagaagctaaaaaacggggaatgaaagtcatcattgttgatgcacaaaatgattcatcgaaacagacgagtgacgtggaagatttaattcagcaaggtgttgatgcattattaatcaacccgactgattcttcggcgatctcaacggcagtagaatctgcaaacgcagtcggtgtgcccgtcgtaacaatcgatcgatctgccgaacaaggaaaagttgaaaccctcgttgcttccgataatgtaaaaggcggtgaaatggccgcgacgtttattgccgacaaacttggaaaaggagcaaaggtggcagagcttgaaggcgtccccggcgcatctgccacacgggaacgcggctcaggattccataacatcgcagaccaaaaactccaagttgtcacaaaacaatcagctgactttgaccgcacgaaaggcctgactgtcatggaaaacctgctgcagggacatcctgatatccaagctgtttttgctcacaacgatgaaatggcgctcggtgctctcgaggcaattaacagctcggggaaagacatattggtgatcggttttgacggcaataaagatgcgctcgcttccattaaaaacggaaagctgtcagccaccgtcgctcagcagcctgaattaatcggtaaattggctacagaagcagcagatgatattttgcacggaaaaaaagtgcaaaaaacaatatccgcgcctctcaaactagaaacacaaaaataattgtctgatgtttaggaacctgcgataacgtgaatagagatatagaacgaattatttctcttacgtgaggagaggaacggcatgaacaaaccaacaaaactattttcaacattagcacttgcggctggaatgactgcggctactgtagggagcgctggcacgatccatgcacaacagccagaaacaacggtaagcattgatgatttatacagttatccgattgattcttatttggtatcagcagaggctctaaatgtcagaacgaaggcttccgcatcaagccaaaaagccgatacgctgcacttaggagatagcctaaagctgatttccttctcaaatgctgactgggcaaaggttcagtataaaaacggaaaaataggatttgtctccactcattacattgtaaaagcagcgacaacggtaaaaaccaaaacaaaaacaaaagtatatacatccgctgatggaaagagcattaagactcttccagcagacacaagcgtttcttttttaggctggagtaaaacgaataaaggcggttttgattttgattgggtattcgttgattacggcggtgcgacaggttatatgaaaacaaaggatttacacatgacaaaataactgagagggattccgcatttatgcggaatcccttttattatgaattgatttgtcacattcccaagatatttctcaggaaatattgtcgtatgctgtgtcgaaaccttacatgatcatcgacacttttgtttatgctaaaaagtggaggtgtccatatggatcaatttgaagcagcatataaatcgtataaagcccagcaaacatcagccaaacagtcagatattcaaactggcctagaagaaattattgcagtcagaagaaatgaggaagacaatattatcgcagtgaaaaccaatacaggaagagagctcgactatcctactgcgctgtcagaagcaaaatcaggaaaactcgctcatgttgatgtcttccataaatacgggcgtgacattttgcgaagtgaaccggacggcatcaaggaaaataacctgtctgagctgccggatttttaaacaaatacagccctgccgtatgttcgacagggctgtattttaaacaaaaggctgctggatgtattcggctaaccgttttgcactgtgagaaatatcccctgcagctgcataattcacgccatagaacacatatggaggcagatacttcatgccgatcagattactcgtggcctgaaatggtttcaatagctcactaatcgagtaatgatttgctccgcccgcttgatatttttccgcttcgctccctgttgatacagccagcatcagctccttgccatgcaaggcatttccttctgaaccaaaagcccagccgtaagtcagcacaagatcctgccattttttcaagagcggcggagagctgtaccaatatagcgggaattgaaagacaatccgatcgtattcctcgcacagctgctgttccttcgcaacatctatttcttcatccgggtattccttataaagatcacgtactgtgatattgtcgtgtttactcaattcctcagcccacgccttattgacaactgaggtctccatatgaggatgaactgccaaaaccaatattttcatcagaccacacctttactgttttgatgttattttatctaaaatcaggaaaagagccaaataaaaagaaagccctgtaaaaggggctttctttttttcttttattcagggcttccttcagttgtttcgatatctttcgcaaaatcagggttatccagattcgcattaaagaaatccgctgtgttcggaagtctgagattcatgttcattttttgagaaatcgtaaccgtgcaatcctcaagcacatagtcaaaaacgtgtccgcctgaattgcgtccttcgtcaatgaagtgcaggtgatagcctgaaacggcgattccgtttgcataagctggtgtcaagaaacctacgattgttcctctcacgttgtcgaagttgaaaatcggctgtgttttgaccgcttcaaccattggcacgtaaggtttttcttgaagttctaccgttcttgtctgcacctttttaaacaatccgtcaatacgaattgcataaaataagtttctgcttggcagcatgctgttgatctctttttcaaagtcttcgcgtgtcattttcgcatcaattttgtgcgtcatgtccggtgtaaagaacgtaaatgaacagaacggtgaacggtctcctttttggaccggtgtcgcggttccgtctgagcgaagacggtaaaattcgccgtcaaacccaatcagctctccgtcaagcttgttaaaggttccgataccaaagtctccatatttcggaatctctgacagttcaaaatctccgtcatatactccgtctaatagagaagtcattgttgatacttgataaatctggctcacaggctgatctttttgaccacggctgagcacttgaatgttgctttctcgtttcatatttcccttcactccttttatttagtgctgttcataaaacagtgtcgtgatgcgcagagtgctagagagctttcgttttcatgagttccccgaattctttcggaagcttgtcacttgctaaattaatgttatcactgtagtcaaccgggacatcgatgatgacaggaccttcagcgttcatgccttgacgcagaacatctgccagctggtctggtgattctacgcgcaagccagttgctccgaagctttccgcatatttcacgatatcgatatttccgaaatcgaccgcagatgtacggttatattttttcaattgctggaatgcaaccatgtcatatgtgctgtcgttccatacaatgtgtacaattggtgcttttagtcgtaccgctgtctctaattccattgctgagaataagaaaccgccgtcaccagagacagaaaccactttttctcccggtttcaccaatgaagcgccgattgcccaaggaagcgcaacgccgagtgtttgcataccgttactgatcattaatgttaacggctcgtagctgcggaaataacgtgacatccaaatggcgtgcgaaccgatatcgcaagttactgtaacatgatcatcgactgcattacgcaactctttaacgatttcaagagggtgcgctctgtctgatttccaatctgcaggcacctgctcaccttcatgcatatattgttttaaatcagaaaggattttctgctcacgctctgcaaattccactttcacagcatcgtgttcgatatgattgatcgtggacggaatgtcaccgatcaattcaagatcaggctggtaagcatgatcaatgtcagcgataatctcgtctaaatggataattgtccggtctccattgacattccagaatttcggatcatattcaatcgggtcatagccgatcgtcagaacaacatctgcctgctctagcagtaaatcgccaggctggttgcggaacaaaccgatacggccaaaatactgatcctctaaatctctagaaagggtaccggcagcttgatatgtttcaacaaatggaagctgaacctttttcaaaagcttgcgaaccgctttaattgcttccggtcttccgcctttcatgccgaccaaaacgacaggaagttttgctgtttggatttttgctatggccgcactgattgcatcatctgctgcaggaccgagttttggcgctgcaacagcacgcacgtttttcgtatttgtgacttcattcacaacatcttgcggaaagctcacaaaagcggccccagcctgccctgctgacgctattctaaatgcatttgtaacagcttccggtatattttttacatcttgaacttctacactgtattttgtaatcggctggaatagcgccgcattatccaaagattgatgtgtccgttttaaacgatctgcacggatcacgtttccagcaagcgcaacgacagggtctccttcagtgttcgctgtcagcaggcctgttgccaagttagaggcacccggtcctgatgtgactaacacgactcccggttttccagttaaacggccgactgcttgggccatgaatgctgcgttttgttcgtgccgggcaacgataatttcaggtcctttatcttgtaaagcgtcaaataccgcatcaatttttgcacctggaatgccaaatacatgtgtgacaccttgctccactaagcaatcaacaacaagctccgcccctctgtttttcacaagggatttttgttcttttgttgcttttgtcaacaccctcactccttattatgcattttaaacgtaaaattttaaatatcttgtgataagtttcactatacactctttggaaattgacctccaatatcgattcgccttatgattaatatgtaatacgaattattaacctatggaaaggaatgcatattgaatggagcttcgccatcttcaatactttatcgcagtagccgaagagcttcatttcggaaaggctgcccggcggctgaacatgacgcagcctcctctcagccagcagatcaaacagctggaggaagaagtcggagttacgcttctgaaaaggacaaaacgatttgtcgagcttaccgcagcaggagaaatctttttaaatcattgccgcatggcattgatgcaaatcggacaaggaattgaactggcacagcggacggcccgcggcgagcaaggccttctcgtaatcggttttgtcggatcagctacatatgaatttctgccgccgattgtccgggaatatcgtaaaaaattcccatctgtgaaaatagaactgcgtgaaatatcctcgtctaggcagcaggaggagctactaaagggcaacattgatattggtatacttcatcctcccttacagcatacagctttacatatcgaaaccgcccaaagcagcccttgtgttttagctttgcctaagcaacacccattgacttctaaggaatcaattacgattgaggatttaagagatgaaccaattattactgttgctaaagaagcatggcctactctatacatggattttattcagttctgtgaacaagcgggcttcagacccaacattgtccaggaagccacagaatatcaaatggtgattggtttagtcagtgccggaattggtatgacatttgttccttcctcagccaaaaaattatttaatttggatgttacttatcgaaaaatggaccaaatacagcttaatgcagaatgggttatcgcttaccgcaaagacaatcataatccgcttataaagcattttattcatatttcaaattgtcagcagacaagaactaaagagagtgatgcaggtacatgaacaatacttgcaatctcttttttcttttgggattcttatggaatttttattaatttaatataatcgcttagtacaactttatatcagtatacgtatacatacagtacaaatagttggcaaggacatcagtaagcgcaggacattagtttgattttaaaaatgaaagatagagaggtgaagtaaattattgagttcaccggcatattcacattgctcgcttttttcgtaacaatgatttttattttctggagaccaaaaggactaaatgaagctatccccgccacatttggcgctttaatggttttattgtgcggaagtgtgtcattggcagacttaggggaaatcggaacaaaagtcacgggtgcatcggttacaatccttgccactatgattatggccattgcactagaaagctttggtttcttttattgggtggctgcaaaactgctccaacaatccaagggttcaggcatcaagcttttttggctaaccaatttgctctgctttctcatgaccattttcctgaataatgatgggagcattttgatcacaactccaatccttttgcttgtactaaaatatttaggtttaaaaaaacatcaaaaagccccatatttattaagcggtgttttaatagccacagcctctagcgcaccgattggcgtaagtaatattgttaatttaatttctctcaaaatcattggaatggatctatatcttcacactgccatgatgtttgtccctagtatgatgggactcatttttatgacttgtctactgtttatgttcttttataaacgtcttcccaagaacctgccagatataccgagccattttcagtctctgcggcatagaaggtaccatcctcttcattcgccatcagctcctttaccagaacgaaatcaaacaaaaatcatgttgtttgtgcttgcatttgtttttctcgtcagaatgagtctatttgcagcatcatataccggtatttctgttcctctagtcgctgtcatcggatcttttatcctgttgagctggagatggatttatttcaaaacctccccaagagacttgttatataaatcgccttggcacatttttatattcgcttttactatgtatgtcttaatttatggtctgcataatattggattcacagagttacttgtgaattattttgaacctgtggtttctggaagcctcgcccatgcaactttcgcatcaggtatctctacttcagttttttctaatctctttaacaaccatccagcgttaatgatcagtacttttaccttaactgaaatgaccctgaatccttcagcaacaaaaatcatctacttggcaaatattatcggcagtgatatcggttcattattattacctatgggaaccttagcaacgcttatttggatgcatatattaaaacagcatgatgaaagtatttcatggggcgaatatataaaaacgaccattatcatcattccgctgactgttctttttacgttaacatgtttatatttttggatcagttggttatttctttagttcagtatgaaacgaaaaactgccttctgctattcaagagggcagttttgtatacactagggaagatgcattgtctttagatgatttaacttccaaatgactggctctccacttgcgttaataagctcaatgatattattagagacaccctttaatagtccgactttttctggcacctctcccatatcaaatatgaccaattcaccaatattttttttgatctgctcctcaaaattacgcacaagaggaactttggaaggcacgaccggcaattgtgagttgtcaagagtatacggtgtttgttcagttgaataaggggtaaaccattttaaatgatgcatagatataaaaagtattttaaatacgggtgagaaaaatacaatataatcgtttaaaacatttgtaacatacccatggatcgatcgacccccagttacataaacttcaataaactggcctttgaccttgtttaatgtatttctatatgaaaaagcttgagtttctgcctctatcaatgggtcttccggattgatcaaaaatggcttctcagtactggtcattattttcgccttgttcatttgatgaagatgcaacaagggaatataaagataattgcagccatcaaaaataacaaaaatatcctgtccgatatctatgagggtgccgacaaaccttgtatctcctgaaatgacaacctcaacatctgtgttaaggaattgattcaaacctttcacgattctcctcctttaactgaaaaagggcatcacttaatctgatgctcctccattatctattaaaatttacgtttccagtgatagtctatcgttctgacaatcgtttcatagctataatcatccttttgtttttctgaacttttgaaggaacttgaataacctggtgatcttgatgattgataatctgatgatcttggtgatcgtttagatgattttgatgattgataatctgaagattttaatgatcgtttagatgattttgaagaactttttgaacgtgacgaacggccagatttggatgattgataatccgaagattttagtgatcgtttagatgattttgaagaactttttgaacgtgacgaacgaccagatttggatgattgatcatctgaagattttagtgatcgtttagatgattttgatgagctatatgattttgaagaaatgaacgaattgctgtccttatcattattgtcttcctggttttgttcatttttttgatcctcttttttgtacgacccttttggacctaagctgatgctttttatgtgaaaaggatagatgcgaagcacctcttgatttttcactatagtataatggccgtcggcattatctacaaggataccctcaatggcttccggacctccacgattaattgaaacccatttatgagtcagactcttaaaaacctcgcttaaatcatcagcttccaaaactccaactggcgtctgctcttctattttcaaatcaggctcgtgtttacttatacttttgatgtgatggatattaaaatacactaccccatcctcattagtgtttaacgcagcgtaatcatctcccagccagaccaatcttccttttttagattccggacccccttggttaaattgaactgattggtttattaaatgtccgattaagctatgaaaatcatcagcatcgagcatttcctcagtctcaattgttgtggtgctattattggtatcctcagtaatacttttcacatgctccaactgataataaattatttttttttcagcttgtaaagctatataatctgattttacagctgttaattttccttttttagattccggacctccacgatatacagtaacaattttatctttcattgagtgcaaaaagttataatacgatatttcattatttgaatgatatttcattctcctcttgctcattcaaattcctcctagtcacttatacatagatgataaacatactgcatatatacgtgtcacatttatttgttgaactaattcaatagcctaattgtcgttttttccgcgaatacccattttcacgcattcataaaatacttaaatgatctttgaggtattgtgaacggtttttaatatactcgcagatcacatccggctcacggtcaaaacgctcaatatcattctttttatacgggtccatgaggacaaacggcctaatccgttcatacatcgccatgattttcggttccatatattctattgtaaaaagagattggagcgttttttctaacaggcgcttgtaggacttgcgaaactcggattcatccaatatccgggcggttagtgtattaaatccttgaattcttacataatcggcagccatccgctctccatggatatccctgccccaagtcgcatcataatcccaaggaatcacctcaaataatccggtttccccgcttctgtataatgcgtagttgtggacaaacccgtcatagttcgaggtgaatacaataccagcaagccagcgcaaatacttatcgacatccacgtgttttgtcacttctgacttaaactgagctttagggaccgtattaattttaaaaatcatatcctgtaaataaaaatcatcttcctcagtccctgttttcttttcatatccaagctccagcgatgttttcgtttccctttctaaatcgctcatcagagaaaagttggcatcatcatccaccgcataaaaaatcgcgccatcagccagcttccttttcgccaaataatattcatctacggattcaagttcaagataaaccccttcattcttcccattcatctttacaaacgcaaactctgcctttggagacagtgtccctagctccgagaaaaaatccagagacaatttgtttctcatcaaggaagggtctttatactccgcatttaagtgaatctctcgcgcgccgcggaatgttttcggctgataaaaggaaatatggtatgacttctttttgaagtctctgatatgtgatccccgataagcgatatcaatatccagccttttttgatttaccttcatcacagctggcaccggatcatcgtcccatatatccttttttaattcacgcaagtcttttggatgaacaaacagctgataaagcggtaaattggattgattcttcatccataatcctccttacaaattttaggcttttatttttataagatctcagcggaacacttatacactttttaaaaccgcgcgtactatgagggtagtaaggatcttcatccttaacatatttttaaaaggaggatttcaaattgggccactattcccattctgacatcgaagaagcggtgaaatccgcaaaaaaagaaggtttaaaggattatttataccaagagcctcatggaaaaaaacgcagtcataaaaagtcgcaccgcactcacaaaaaatctcgcagccataaaaaatcatactgctctcacaaaaaatctcgcagtcacaaaaaatcattctgttctcacaaaaaatctcgcagccacaaaaaatcatactgctctcacaagaaatctcgcagccacaaaaaatcgtaccgttctcacaaaaaatctcgcagctataaaaaatcttaccgttcttacaaaaaatctcgcagctataaaaaatcttgccgttcttacaaaaaatctcgcagctacaaaaagtcttactgttctcacaagaaaaaatctcgcagctataagaagtcatgccgcacacacaaaaaatcttatcgttcccataagaaatactacaaaaaaccgcaccaccactgcgacgactacaaaagacacgatgattatgacagcaaaaaagaatactggaaagacggcaattgctgggtagtcaaaaagaaatacaaataatctaagttttcattgtttcaataggctgccggcggaggtacggaagcctatttttttatttgccctgtattagatatatgtcatgacataacatatgcaacccgcatcatttggtttcctttaaaccatttcgttataatcaaggtatcctaacgataaaggcggttgttgctatgtacatatttcaagctgatcagcttagtgccaaagacacatacaagctattgtcaggtaccgttattccccgccccattgcatttgtgacaacactttcttcaggaggagcggtcaatgccgcgcctttcagtttttataacgtcgtcagctcagatcctccgcttctcagtatttctgttaacaggacggaaggacgccaaaaagatacagcacgaaacgcagtggagaacggagaatttgtcgttcatgtcagtgatgaagccatcattgaagatatcaatgaaacagctgcaagcttaaggccggatgaaagcgagcttacacgcacctcgcttcatcctgttgaaagcaaagctgtttcagttcccggcattaaggaagcccgcgttcgctttgagtgcaaattagagcggcatattacctttgacaatgatcaaggcatcactacagcagatctgctcatcggaagagttgtctgcttccacctagatgaaaaggtgtatgatgcagaaaagggatatattttaacggatgaattaaagcctgcctcacgattggcgggaaatcactatgccaagctgggggaagaattcacactgattcgtcccagctgaagagaaggactatttaaatagaagaaactagtcaaaaagaccttatgattacaaaatatcgcctgtaaataactgaaaaaatatcaaaaaaagaacacccagagtaagctcggggtgttcttttatgaaacgtttttcctttttcttcgtataaaggtagattaggaggaattggaatgacaaacttttggattttaatgctgatcgctattaccatcagtctcgcctctcaattttttataaagaaaaaatacggtattgataaatccggctggcgatataagcatgtcagcaatacacacaaatggatcgaaatcactttacttattttgtttgtgttttcactctccttttttccagttgaatatttgcttcttttattttttattgtgattgactcaatacgaatttttatggagtggcattatagacctgaagataaacagtatatgtaccacattgtagaggtctcccttatgtttgtgcttttgatttatatttgtaccctatagttatttaaatccccacagccgctccgtctccccgaggatcggctccgccttggagaaagccttcttcatcaactttgattgcagccgcgtgtcccatcagcggatcatagtcaccgacaacctccacgagatgcccgctgtctttcagtttttggattgttttgtctgtgaatctgccctcgactctgagaccttcgtattcctctccccacgttctgccccatacccagcgcggttcgctgattgcctgctgtggatgcattccgtagtccagcattcgggtaatgatggccgtctgagtctgcggctggccttcgccgccttgtgtgccgtacagaatttttggctttccgcctttacagaccatagccggcatcaacgtatggaaggtgcgctttctcggttcaagcgtgttgacatgattttcatccagtgagaaaaatgatccgcggttttgcagtaatatgcctgtatcaccggcagtgactgccgagccaaattcaaagtacaggctttgaatgaatgacactgcgttgccatccgcatcaattacggccgcatatgccgtatcacttcccaccggcctgctttctgccggttctgccagaatgccgatttctcccgccaatcgtttcgcataatttttatccaaaagcctttcaagcggaatgtcagcaaacgcagggtcagtcaaaaaggcattccgatctacaaaactctttttcagcgcctccacaagcacatgataatactcaaatgaaccgtgctcgatttgggtgaaatcatagttttccaaaatgttcagtgttaataaaccggtaaatccctgagaattcggcggcgcctgatacacactgtatcctcgataatcacttgatacaggcgctgcccactcaccccgatgcgctttaaaatcatcgattgtcatgtaactgccgttattctgtaaatgtgagacaatccgctgagcgagatctccttcataaaatgcgcttcttcctttttcagcaatcaagttcagactgtctgcaagctctttttgcacaaaccgctctcccgggacaggcgctttgccccttctcgtgaagatgtcagccgtgtaaggcgtggaagccagcagttcaatattcttttctgtgtgacgacactgatcagctgatacaggaaacccattttgggcataatcgcgtgcgggctccaatacatctgcaagagacagacgcccgtactccttcaggaccgcatcccagctatcaaccattcccggcacggtaatggcactgtcaattccccgcagcggaatcgcgctttttcccttatatacatctctcgttacgttttttcctgaacggccgctgccattgtagacttttactgcctttgtttcctggtgaaaggtcagccaaaaggaatccccgccaagtccggtcatatgcgggtacacaaccgcaagacaagcactcaccgcaacagcggcgtcaaacgcgttgcctcccttatccagtatgcggtttccggcttgagaagcgagataatgcggactgacgaccatttgctttgtaccgatgacagatttgttcatcacaagtccccttttttaagaaattttcttcagtatagggagcctgatttttcacatctactgatccggcagaaaaactgacgaactttcttcttttcgcaaataataagatattttcgcattcatttcgaaaacaaatgaaaaattattatttcgatacgtaacttttatgataaaatgattgctaaaaggctacgaaagcaggtggagcaattgagtcatgaatatcaaatccccaaccttgtacttgatgagactgataaacaaattctcacgattttgcatgaagaaggcagaatttcttatacggatcttggcaaaagagtcgatttgtcacgggtcgccgtgcaggcccgtatcaaccaattaattgaagccggtgttattgaaaaattcaccgctgtcatcaatcccgctaaaatcggcattcatgtttccgtgtttttcaatgtcgaggtagaaccgcaatttttagaagaggtcgctcttaagcttgaggaagagcctgcggtcaccagcctttatcacatgacaggcccgagcaagctgcatatgcatgggatctttgccaacgatcaagaaatggaagaattcttaacaaaacggctgtatccattgcgaggcgtcgtcagtgttgattgccagatgctgatcaaacgatacaaaagccgtatgggaatgaagctgtaaaggagagaaacgaatgaaaaaccatccttatcgggatatgacggccgcaatggttcgcaccggcatattagggttcggcggcggaccttccgtgattccgctgatccgccatgaagcggtcaataaatataaatggattgacgatgatgaattcggagaaatattagcaatcgctaatgcgcttcccggaccgattgccaccaaaatggctgcttatctgggctttaagctaaaaggcacattaggtgcagttgtggcgactctcgcccacattctgcctacatgtcttgcgatggtgggcttgtttgcggctgtaaatgtgttaagccattcagcaattgttgcaggtatgattggtgccgtcacgccggtaattgcggtcatgctcggaatcatggcgtacgagtttggccaaaaagcgcttaaaggtttcggctgggtcaccggcatcctgttttttatcatcgcttttatcggcctgcaaactttacagattaatcccggccttgtcattatcattttcttagcgtacggggcgtttcattttaaactgaaagacaaaatcacaaataaacattcaaaagataaaggaatgtcagcctcatgatatcgatctatttatttatggcgttttttatcgcaaacctactgggatatggcggcggacctgcgtctatcccgctaatgtttgaagaagtcgtaaacagatacagctggctctcaaacgatcaattctcaaatatgctcgcacttgcgaacgcattgccgggcccgatcgccacgaaaatcgctgcgtatgtcggctacagcgcaggcgggtggcccggcttcctgattgccctgatcgcaaccgtcgtaccgtcggcgctcgcattgatcgtcctgctgcgcatcatccagcgcttccgccaatcacctgtcatcaaaggcatgacgctgtccgtccagcctgtcatcgcggtcatgatgctcattcttacctggcaaatcggcgcagacggcatcaaagcgatcggctggatccaatcgatcgtgattgcgggaatttcgctccttgccatgacaaaattcaaaatgcatccggcatttttgattatcgcggcgtttttatatgggggccttgtgatccctcatttatagaaaaaagcacctggacaggtgcttttttattttggcccagaaatgccgtttgatatgacagctgtttcttctcctgcgtcactcttgatgatgtgcttgacttgcagcgtggttcctgccattctcacagattgcttcaactcggacgaattggtttcaacttgtatccaaacaggaggctggaccttccaaaataaatagagtgcaagaatcagcaagccagcaatgaccgacagcaaaaacttcatatcgcatcgcttcttttcagtaagcggcccgcagcggacagcgcctgatgatcacgaagaatatcgcctggacgattgccttctcccagcacatagcctttaaaggacattcccataaaatgaaaaatatgttcgaattgctgaatcagcggcagcccttttatttttggattgtctccgcccactgctattacatatgcctgtttcactgacatttgctgtttaaaatcaggaaatctcggatctctcaacgtctgtgaccagcgatcaataaacagctttaatgtccctgacatgccaaaccaataaattggggtggcgaatacaagaatatggcactgcaatatccgttcaatgatagaatcgtagtcatcttgaacaggacgaaagccgccttgggcgtgacgcagatcttcaattggctgaattcgatatttctgcaaataaatgtgctccgtatcgaatccttgaacagccttctccgcaagaacatccgtatttccgccagaccgagttccgccgttaataaccgcaattttcatgatgcatctgctcctttgtttacgaatgattttcttcatcttataatggattcatcaatcaatacagatgattatttcgattaatccaatcgctaaaaccgatttagaaaggaagagaacaagtggaattgaagcagctgatcacctttattacggcggcagaacatgtaaacttcaccctaaccgccaaaatgcttaattatgcacaatcaagcgttacctctcagatcaaatcacttgaagaagaaattgggacgcctttatttgaacggctcggcaagcggcttatcttgacagaagcaggaaaaacgttcaaatcttatgcacagaagatcattgcgttaacagaagaagcgaaaatggccgcaaatcaagtaagagaaacaaccggaaccttaaaaatcggggcgacggaaagccagtgcacataccgcctgccgcctatcataaaagaatttaaacaggcttttccccaagtaaagctcatattcaaaccatatatctccaatgaacaagcgaaagaacagctcttacagggccagcttgatatcaccttcatcttggatgtaaaccggatggaagacgcactgcacgttgaatctttgattcaggatgagatcaaaatggtggctgctaatgaccatccttttcctgcggatttaccagtaacattgaaggatcttcaaaacgaaactcttctgctgacagaggacggctgctcgtaccgcacgctctttgagaacaatttgcatgactccggtgtctatcctaacaaattggaattcgtcagcatagaagccatcaaacaatgcgtgatagccggacttgggattggaatcttgcctgaaatgacagtaaaagatgatattgcagcaggccggatgaaagaactcaattggcagagcgattgccccgttttcactcaattagcatggcataaggacaaatggatgtctgcgccattaaaggcttttatcgatttgacacggaaaacattcaaataaaacctctccacaaggacgacaaggtttttgagaccaggaaagcacacacatacaaaaaaacacttgatgacttagagccccaagtgttacatgtgatttttctgataaaacgttcgcaaaacatgcgtttcaaggtcagctaggcggacagggattggcaatctgctttcttgattgatcaagctcatcgtgatctgatagctgctgtctaaatcaatataattaccgcaagacaagaaaataggcttcacgtccccccgcgttcgcagcgcccggccatatacctcgccgtcaatgagaatatcggtgtatgcaccgacttcattttcaggcatcacgaaatcatagcctttgattttgagataggttttcgcaatcccaatcgtcggcttgcccagaaaaaaagccgcatgggtggcaacgcccatatgattgtaatgcagatatccgttgccatcaaacaagaagacatccggctccgtctccagctttttcgccgcctcgatgatcaaaggcagctcgcgaaacgcaagaaaaccggaaacatacggcacgctgattctccccatgctgtgcactttttcaatgacttcttttgtatcagcgtcaatcacgataatactgcacactccgtatggttctccgttctgctcccaataggcgagatcgacgcctgcgcaggtgttgatggagtctaggttgatggaggtggataggttgattttatggataagggattgttgtgtttttacaaattcttctctgtttaggttgaaagaatgtatttgtttaacatgcatctaaaatcaatcctacctcctgttaactagtgtctgtttttctttgtattcatttttactttgaaaacttacaactccaggttctgcaaactgtattaatagttctaattaaatgtttaactacatttcattattcgtaactttgtttaatataaattctatatttttaactatttcaatatggctatttgtctgaaattcatatatgggttgatcccaatcctcattttgcatcataactagttgataaaatccattagcatccgcatctggataccaacctaaatcaagtaagtaatttttacgagagtatgttaattgcattaaatcttgtgaaaaaaacaaccatttttcatcgtctggtgctaggtttttcggatcaatttctctaaaactgttttgatttatggtccatccttttggaattcttaagggttgtaaacttatttctggcattttttttatctttctcataaaagcctcctattacttatcaataccaagttgttttaaatacttatctaatcgacttccagcaatcggatgaccatgatattcaccaccagaaaactccgctctaatccagcttgttggtgtacctagatcataaccgactgtttttcctgcatcataaatgaaataatagttgttatttccattatcaataatatgaccttttagaagtgcctctttttctaaagctttgttattcacatctggtaagtactgagcagcttttttacctgtcatactaaaacgttttgcttcttcaggtgttttagctttaacatgtttatggccatgcggagtaaacgaagcattattaagcatcgttctaaattctttacgaccataatatccatcgtgcgctactttatcgtgatttttagaaatgttaggactatgagagcttcccttacgaccgccatcactaaccatcttcacaatcccaagatccttaacagccgtcttttccacatctacacgtactgtcgggattccgaatgtgaagccctccggagttactgggcgttctgcgtacacgcggacgtttgttgggactttgaattgttttactttctctagtgttttgtttgctttttggacttttgaatgggttgcaagcgggatgcctttatcaatatgtttcgccaatgcaccggctccaaccaagctcaatgccgcttcgagcgccccttgcttccgcttctcctcagacactttgtttccaaacatatcccgtcccgtgacggcttctgagaatccgtttgacgcaacaaggccgtatgcgcccatttctgtcattttgagaatgtctaaggatttgcctgttttgtaggcatctaaagcgtgttcagccgcgatagcagcttttccagttttgtagatggcttttccgcctttgaaggcgcggcctgcccagccgacgactggtataaatccggctgcggccatagctcctgctgtcacacgttctgcggtggagagtttttctccggtaaccgggtcaatgccttcagttgctcttttataatcataatagccagtgacttctccagtaaagttgcaaactccatcccatgttttttcgtaccatggtttgtttgcttcttcctcggctttttcctggagacgtcttgcttctgcttgctgggcttttgcatcaatataggttgttccttgattttctacttcaatgacgcttttgtagacttcattgctgtggaaggcttttttgtcatagtacataggggatgcgctcttcccattgctggtggcctgcatgagaacagaatatttggtgagcactgcgttgtccagagattctaaattttgatattcagtggtcagggattcatcaagcttatcgacagctgtgatcgtgtcacgtctgactttttgggcatcgcccatcttatctgcatactcgtcaagcgtgtacatgtcgaggtcaataatatcgctgatgcctgacaaaatagaatcgatttcttctttatgagcggagactatctctgaggctttcaggtctccattgggcagctcatgatccaaaaatgaagtttccacatatgaatcattcagttcttgatctttaatatcgcctgaaatgccgtttaaaaatgcaatttgagcagagacaagcgtcagccagctgtcgacgatttccgcctgtccctgaaagaaatctttaatattgtccgcgccttttcctttaaaattatcgcctaaatctgcaactccctgaaacgcttttttcagcgtattcagctgctcttcaagcgtctcatattgcttttttctgctcttcgcttcttcgattaaagattttgattcaaatactttactcatcgcactgccctttctgttctattttaccgctatcgcctcgtcctgctctttaagtgaatctacgttatcctttgtatcctcgatatttttctgtaccgcttttttgtaatcaccgagcatggttttgatgttctcctcacgctcatgatattttttcgtataatcgagtttattttttccattggaccccgcggcgctgattgatacgtcagcaagcgcatctttgacagaatccaatgttttgatgactgtgtcgtacttcagcttaatttctgacataaaaaaagatcaccaccattttagtttactaatttgtcttcctgcttcttctacgaaatcttctcctttagcaagaaggtcgcctgcggcattcgctgcactttttgtcaaattaagctcaaatttctctgtctcaagccagaatattttgctttgaatcgaagccatatactcgttatatttatcattcacaatcttagatgcttccgatttcgcctcttctcttcccttgtcgaaatcatcggcttttgttcccgtccaatgcttgcccaattccggtttcacaatttctttgatttcagtgattgcctcttcttgcagtgtgtctatgtccttttttgcttttttcagcttttcgatcttgtcttccacgtcggaaatttttccgttgagcgaacttttgatatccgctagcatactttcataacccatctgaatcacctcttaatactcaaaaagtcgtatggaggggctgatgaagatagacttttccatactttatttccatatattatattttaaaatagccagaaggcggcttaaatagggtaaatggcttaatttaggcatataacgctcttggaatgtaggtatttgatcttgtttttgttcgttatacagctaatgaaaacgttttttaaaatgaaatcacctaaagtcatagttataaaggcacttgaaagaggcagatgttgttgatctgcctctttcggcgctgagcttattgttcatgtttatgttcttcatctggtcggccacgtctgattttgtcatttggcttctattattccccgcttctgaccctttggatcaaaagcttgtattagctgcagtcccagttatacagaacgtttgaaaagtcttttttccttagatcgtcaggtgtgatgaaaaaattggcgatgccgacgtctccccacattgaatcgatatcatcgtctgaatcaatttgtaaaagcatgatggtgtgttctttatatgcgtattcccggggatcatgctgggtaaaagaagcgtatccgccaattttatggccaaatccgttttcagccagttcattataaatgtcttcttcatcctcgccgaactgaccaaagaactccattgtttccatgcctgtatactgctcaaattgaaaatctgtaggcaggacccattccgaagatttcacaggctcgactgccgcttctgataaaatcggaaaatcacattcgcctgtgccaataaatgaaaaatcagaaacaagctcgtcttcgttttctatgatattttcaaaatagatcactctgaaatccttttgttcacatcgatcgtcaaaattcaatccatagacgtcatcatgaacagaaatgtagaactgcaggatacctgaagaagggtagccgtcaagctggggaatgtgcgagaaattaatctgtgacagaagcttcatcggctgtccattttcatcagtcgggtatgtttcatgcttggggaaatagggatcaccggcaattttgctgtcatatcgtcctgttttcccttttcggacattcaatttcacgtattctttcgctgatttctccagcaagtcgcggtacggtctcattttttcgggcagatgattcatcagattctctccttttccggcatctccaattatttttgaaagattttattttctggttttcttcgtttcttctaatgtttttcaaacgattgtttaaagaagccctacttctgtataattttccaaacaatagttaaatagtagcaaatgtattcagcaccccgcaatagatgaaaaaaagactggtgcgcaaccagcctttctttttcatctattgaattgcacctgacggaacaaccgccttccgaccgacagaataatactccactcctgaagccgcagcttcatccaatgtgtagcagtttctgccgtcaaatatgagcggcgattccatcaaatcccgataagcggctaacggaaattgtttaatgtcagcccagtcggttaaaatcatgacggcgtcagaccctttgacagcttcctcgatcgtctctttatattcaacagcttgcgggagaacatgctttgcatggctaactgcaatgggatcgtaggctctgatacgggcgtcgagcgcagcgagacggtctgcaataacaattgacggcgcttctctcatatcgtccgtattcggtttaaatgacaggcctaaaagggcaatcgtttttcccgtcaccccgccgagcctgttcagcgctttatcaaccagcatcgcctgctgattgttgttgactttgataaccgatttcagcagttcaaaatcatgctcgacattgccggcaatttgcacgagggcgtttgtgtcctttggaaaacaagagccgccgtagcctatgcccgctttcaaaaactggctcccgatccgcttatcctgtcccatcccgtacgcgactgcttcaatatcggcgccgaccttttcacatatattcgaaatttcgtttataaaactgatcttagtggccagaaaagcatttgaggcatatttgatcatctcggcgcttctgatatccgtttggtaaatcgggatttgaaacggacggaagagctcctccagcgtatttgcggttttctcatcggccgtcccgatcacgatcctgtcaccatgaaaggtatcatagatcgccgacccctcacgcaaaaattccggattggatgcaaccgaaatactgacaggctccgctagatgttcagtgatcagtccattaatcaaatcgtttgtcccaacgggcactgtgcttttcgttaccacgactgtatctcgtttgacatgctttgcgatgcgtttggccgcatctgtaatttgctccagattggcgtgcccgtcgcttttctgcggtgtgccgaccgctataaaaatgatgtctgcctgtgccaagcctttctcatagctcgtttcaaagttcagccgtccataagctgtattttttctcatcagctcttcaagacctggttcaaatatgggggaaatgccctttctcatttcatcaatcttgtgagcgtcaatatcaatgcaggttacatgatgtccaatctcagaaagagaaacacctgtcacaagaccgacatagcctgttccgatgactgttatattcattgtttccctccaacagttaaattgctgctttgcagcttccgtaatatcgtatgagaacatcctatcatgaatgcgaatgatctcccgcatagcctgtcgggtacagcctgtacagatttctgaaatgtgattcaaccatacaatacactattatatcgctctcaaaaagaaagtggtgaaatgagaatcggctgttaaaaaagaccaaacaattttcttcttttgaccggttgcggaggctgtctgaagatggtctgattccgcaggagaagctctgcattttccgtcagcatataaggaagttccgagccgaattctttctctagaacataaagagcctcttgagtgtgaaaatttctcgttttcacattatgggcatctgaggctacgaaatggatcaaattggcttcaaccagccggagagaaaatgctttcagctgcttgccgaaggtccccgcaagacttcctgaagtaatctgagatgctgctcctttttccacaagatgatacagcaaagacgggttttcgcgaatttccctgttgcgttcaggatgggcgataaccggaatatatcctttcagctgcaaatcataaaaaagctgctccgcatatcggggaacgtgatcaaacggaaactcaatcaagatgtgttttgtatcattcagcgaaagcagctgctgtttggcaaggtcttgttccacctcgccgtagattctgatttcctgtcccggaagcacatgtaaaggaatgtcttctttgattaaacgtttgtttaactgatttgctgcttctctgactgcggctggctcgtttttatacacaccgttgttatgatgaggtgtcgcaatgatcgtccggattccctgacgaacagcggctcttgccatttctatgctgtcggccgaatcacctgccccgtcatccaatgcgggaagaatgtgacagtgaatatcgatcatgtcctagcccccttttttcgcaaaaataaataacgggcacgatgcacgttatttattttgcatgaaattgtccttgtttccgtaatatccgtattcagagtgcttcgaaagctttttgccgttcataatcgccccaaggagcttgcttttgcacgtttcaagcgcctctttcgcttttgcggcttgttctttttctgttttcccacttgaaataaccagaacagaaccgtctgccacgttgcctaaaatctgtgcatctgctacggcaagaataggcggcgtatcaaaaatgaccatatcatatgccgcacacgcttcgtatgcaagctccttcatccacttcgaggagagaagctcggccgggtttggcgggatcgggccgctcgtcagcacgtcaagatgtttttcattcgatgcttgtacagcctgctccatagagcttttctttaataaaacagatgttaagccaaccgtattttcaagaaaaaaggccgtatgtactgttggttttcgcaaatcagcatcaatcaggagcactttttttccctgctgggcgaatacgacagccaggttggcggccgttgttgattttccttctccgggacaagccgatgtgatcatcactgatttcatctggcggtccactgaagcaaattctatattcgtgcgaatcgtccgatattgttcagagttcaaggatttcggctctgtcattgcaatgacatttctccgcatccacgagtctctgctttttctaagcgccaaaatgtccactccccgttttttcagattggaaaccctgtaaggtctttgctgttttctgctcattcgcaatggtggaaactgtccctaaaacaggtatgtccagcaaggattcgagctgctcttccgatttgatcgtattatccaaatgctcaagcaggaaggccagtccgatgcttcccgccaatccggccgcaaacgcgatggcaatgtttagtagcggctttggcgatacaggggacggatgttctgaaacctcggcttttgacagaatgctgacattgtcaacattcataatggatgtgattttgtcttgaaaaacagatgctatagtattggcaatatgagccgctgtttccgcgttttcatccctgactgatatgttgaccacttgggagtcctgttcgctggatacggtaattttgtcattcagttcttgggatgtcatcgacaggcccatttctttaatgacttcatctaagatggcagggctcttaatgatgacattgtacgtattgattaactgaagattggtttggacatcgttaaattggacttcttttcgttcatttttcgattggttgaccagaatctgagttgaattttcatagatgggtgtaagtgcgaagaaactaatgagtccgccggcagcagtggcagctgcggttacaatcataatcaaaagtatgcgttttgttaacgttgataatatctcttttaagcttgtagattctcccatgatacctccaaatctcttataacatccttttccatctacgattatacaacgttgaaaccgcatttctccagcttttcacgtgacataattcgacatttttttacaaaacgaaatgttgctcttttttatgtaagcgctatatttactgtgttgacagcgctgtctcattttctcttattcgtgcagtcacgtaacctcgcataaaaaaatcccgctaaaggcgtgcgggatttttatgttgcatatccatttttaatatgagaaatcaaattttcaagcatttccttcgtcgtcatctcagatgactgctcaccaatttcatgtgcatgcatcaaaattttcagaaattcttcttgattcaatttcttttcactcatcttttttttcctttcagcttccattaagttgaaaacacgattattatatgatgctggttatcaatttgcaatctctaatacatcattcgacacatcccattttttatgtccttttttaggaaaaactttttaaggccgatgtgttgcgatataatagagaaattggatctttttattacgtgactcggttaggagcgataatcatgcttcagaatatgatttccaaagacgatgtgctggcatctgctgaacagttaaaagaacttcttccttacaatgaggaaaatgttcagctgatcaaaaaagcccttattttatatcggcaggattcagtctatcgtttacaagcagtgagtccgacggaagttacggcttacgtgcaggatgttgtgcctgtgcgggtcacattgaacttgtttgtcatagtcaaaagcggctgttcatgtccgtccggaagaatctgccgccatatgctggctgtgtttttatatgtatatgcaatgttcgagcgagtgggtacttttacagagtattggctggagagggaaaagcttgaggaaagcaaagagctcgtccgccgccagtttcaggaaaaggtgctgcctaatgaagaatcgctttcaagctggcttgctttttttgattcagagttttctctctggcaggcacgtacgccagaaggcagccaaaacatgcagggcctctattacggctacctgtccgcattaaaaaaacatacgccgaacaagccggagctgaaaagcctgtaccaaattcattccgcgattgcggtttggcttcgcatgttcacattgattgaagcgggaaagctgaaccccgaacaagattattattccctcaatccgtacgttgaacagctgatggatacaatctacagctctattgataaattaaaaacatacgcgctgtcttttgcgcttgatccgtttttggataaaacaccggatgttatccgacatttgctgttgaaagaagaaattttccaatatgaacgcatccgcgtcttcggtgaaatttggagtgcgctgctttcgcgtccaaaatgggtgacacgcgaacaggagatgttgaaaaaagaagcaggacggcgtttttctcccgaattgcaattcgggcgcctgcatttggaattcctgcaaaagaatgatgacgttatttttgcggaagcggatcaattcccgccggaagcgctcccttatacgttccaatggctgagtgaaatgactgccaagaaggactggaaacggcttaaaacatggtaccagcaaattgagccaattgcgatgggttatacgaagctggataagccgtttaaagagattcgcgatgtgatcggcgagctgttccttctgttgaatgcctatgtgcagcaaaccaatgatcaagcgctgtttgagcgctttgccgcgggctgtctgccgtatacgttcacagaatacagccatcatttatatgaaaaaaaacgctatgccgagtggattgaaattcatagccttgtcggcttttccatcaatgaaatggataaaatgatgctcaaggaaattgcagcgagcgaccctgaggcgcttataccggcttaccatagagaagtggcttttttcattgatcagaagaaccgcagctcgtacaaggaagccgcccggtatttgaaaaaattgcgcaccctgtacaaaaaagcgaaaaagcagaaggtgtgggagcggtatattcagctgctgagctcgcattacaagcgcctgcgtgcgcttcaagaagaactgcagaaaggaaagttgattgatggcgagtcttaaagaaattctcatccacgtcgaacaaatggaagatgggtcatttacgctctcagcctttgatgaaaatgagcagcctcttccctacagccatatgaaaaagcatttgttccaatggcatgaatcctcattttacggaacctttctagaggatgtcagcttcatcgggacgactgctgtcctgctatcgccatggatgactgtagagcttctcggcaaaaactcgttcaactcattcagctccgtgcagcttacagaagaaacggagccgctgatcgaggcggcatcgaccatctatgaatttatcgcggacggcgattttctgcctgactatgacgcatggacaaacggtgtttttcgctggaaagaccgcgataatatactggaaggctttactgcggaatggttttccgctgccgtacaggattacatccagtacgacgatgacctgcgggagaaatgggaacatatcaaggaaaaatcgcctgcggttacgacattccgcggccattttcttgatgaagaggattttctggaaggcattggctggattgacgatcaatctccatttactgtcggcttgcgcttaaatgaaccggactttgacggagacgaatggaagatcgagatgtttttacgcgataaaaagagcggcgctgtagaattctttgacggactgaagagcctcaaaaaatcgtggcaggcgtacagcgataaaatcgcgcgtgagcaggaccgctttcacagaacggttccgtggctgtcgtttgattccgggacaacgctgatctcggaggaagaagcctggatcttcctgtcagaagcaagtgagacgcttgtcgatatgggggtagaaatcctcctgccgtcctggtggcagattgtcagagacagcaacatgatgctgaaagcaaaggtgtcgtcctccccgcgcggcgagtcatttgtcggcatgaatgcactgcttgatttcaactggcggttcgcgacaaatggaattgaactgactgaggctgaatttaatgagcttgtcgccagcaacaggcgccttgttaatatccgcgggcaatgggttaaaatcgatccgcagtttatcaaacagatgaaacgcctgatggaaaaagcagaatcagagggactccacatgtctgatattctggcgcgtgagctaatggatcagcaggatggcggacttgaggattcggatctgattgatacatccgctttcgcaggcattcagtttgatctgtctaaacagctcaggtcactgattcgaaagctcactgccgcggaaaacctgccggagcacgaagtcagtccttctttcaaaggaacgctccgcccttatcagaaatacggcatgaactggctgctgtttctgcgggaaagcggttttggcgcctgtctggctgacgatatggggcttgggaaaacgattcaaatgatcgcctatttccttcacgtgaaggaaagcggccggcaaaaaacgcctcatttgattattgcgccgacatccgtacttggcaactggcagcgggagcttcaaacctttgcccctgatctgtctgtcgcgctccattatgggccgcgccggccaaagggtgatgatttcgccgcgcattatgaaaacgcagacgtggtgctcacttcatacggtctgtcacatgccgatactgaagagctttcttctgtgacatggaacacgatctgccttgatgaagcgcaaaatattaaaaacgcgcatacgaagcaatcacgcgcaatcaggaagctgaaggggcttcaccatatcgcgctgagcggcacgccgatggaaaaccgactgactgagctgtggtctatttttgacttcatgaataaaggctacctcggcagtttgaccggcttccataaacgctatgtgctgccgatcgaaaaagaccgggacgaaaagagaatcggacagcttcagcaattaatccggccattccttctccgccggacgaaacgggatgaagaggtcgcgcttaatcttcctgagaagctggaagaaaaagaatttatccctctgtcagccgagcaggcatccctttatgagcagctcgtcaaagacacttttgaccatatgacatccctgaccggcatgcagcgaaaagcgctgatcctcagcatgcttggacggctcaagcaaatatgcgatcatcccgcgctttatttaaaggaagagcaaaccgagctgctggccggcagatcagtcaagctcgaaaaattgctggaactgatgacagcgatccgctcccaaaacgaaagctgcctgattttcacgcaatacattcagatggggaacatgatgaagcggctgcttgaaaaaacgttcggggaacctgtgcaatttttaaatgggagtctctccaagcaagagcgggatacactcgttgagaaatttcaaaggaaagaatatccgacactgattctttcactcaaagctggaggcaccggacttaatttgaccgccgccaatcacgtcatccattatgacagatggtggaacccggcggttgaaaatcaagcgactgaccgtgcataccgcataggccaggagcgctttgtccacgttcataaaatgattacgacgggaacaatcgaagaaaaaattgatgtcatgcttgaatccaagcaaaccctgaacgatcaaattatccaaagtgaaaactggattaccgagctttccacacaggagcttgaagaactgtttacattaagcgctacagcgcaataatcatgactaaaaaagctggctctgatagagccagcttttttccgttcatagccgtcacgccgaatctccaaaaaatccgttacgccggttatatcaacaggatgcgcttttggagcagcacatatacctacagcaaatgtttcatcatatgtgcgacaccatgttcgtcattggttaaggtgacagcatcggctatcgatttgatgtcttcccgggcattgcccatcgctacaccttttcccgcagcctccagcatcgatttgtcatttaaactgtcacctacagcagcggtttcctcgagcggaatattcagctgttttgcaagcctcttcagcgcctgccccttggaagctttgcgggaagaaagctcaaagttgtgctcagccgaactgacaagcgtcaaatcttcggcatgctcatatcttttccagcctgcctcaagcttttctttgaagaaagaaaagccgagaatattgtaaaaatcgattggctgatcggcttcaaacagctcttgaaaagagttaatgtaagcaaagcccgattggctgtattgcacctcggccgcctgcttaaggacagaaagatctgtttccgggtttgcgcttctaaatctgtccagctcaacatcaagaagttctctgccgttttgcggcgtataaatcgctgaacctgtgaatacctcataataatagttttccgactcaagccatgagagaatgtcatacgcccgtttcttatcaatcgtttcgtgatgataaagcctgccgtcgggatcgtgaatgacggcgccgtttgcactgatgacccatgttttgatccccagcggttcaaagattgacatgacgtcaaaatgagcgcgcccagttgacaccaccacttcaatgccgtccagctgcgcctgccgcagtgcgttttcattttccaagcttacctgatgcttgctgttgagtaaggttccatctaaatcaatcgcaattaatttcacgtttgtcagtcctttccttcatcctgctctgtcacgagaagctcaacgccgtttcggtcaagcaagtcacaaaatgcctgattcggaagcctgtctgtaatcaaaaggtcgatttcattcagctccgcatactgataaaaactggtgctgcccagcttcgaatgatctgcaagcgcgatgacctgctttgcctgctgtatcattttccgcttcaccatgccatcctcttcatgcgcaattgtaatgccatgttcggaaataccgaccacaccaatcagcgctttatcaacatggtagcttgagagcttttcaatcacagaggacccgtacagaaagcggtgctccttttccagcttgcctcccagcagataaatttcaattccctctttatcggacagcacatccgcaagattaatcgaattggtgattaccgtacaatcaaccgcattcaaatgctttgcacatgcctgaacagttgtagaggcgtctaaaatcacccggtctccatcatgaataagcgatgctgcaagcctgccgatcttatttttttcctcagacactgttttcaggcggccggaatagctttgaattttctgatgcacagtcggcaaaatggcgccgcctcttgtgcggatgatggcattctgttcctcaagtttcacaagatctcgtcgcgctgtatcccttgacacttgcaggagcgtacagatctgctccgttgtaattcggttatgctgttttaaaaaatccaaaatcgctactaatctttcttcttggtacacgccctcattccttttctcagcaatcatttataagtaattataagtttttatttgattttattcaacattaataagtggttttaagtaaaaatgcgtcgagagaaccaatttttcctaagtaggcaaaaagaaagaaccagtctggtcgactggtcaattttgaggggatgatgcgaagatccggataatagtgaatggatagataacgggaggagcaggggtgtcaatcagcagctttttcccggggtttagggtccataaaacgaacagtgtcagccaacacttctgttacatacacgttaacgccttccgtgttttcatagcttcttgtctgaatccgtccgcttacgccgacgagagaacctttttggcaatacaacgccgtgttttcagctgtttttctccaaagtgtgcaattgacgtaatcagcttcgatttcacctgaagcattcttgaagctgcggttcaccgcgagcgtaacatgtgcaactgccgcaccggcggaagtgtagcgaagatcaggatcttttgtaagacgtccgacaagcatgacctgattgaacatgcgattcctcctctccttgcggttgtatgtattgtaaatgatgcaacaagaaaagaaaaacgcttaaaaatggctttcagcctctgtttttatctttcgttttcatttttccttcagctaaaaacatcttttgcttttttcctttgaagaaatatgtactttttaaaaaacggaaaaagatttgctttgtcagccagttttgcgtattcatgcgcacataggaagagccatcccacgcaaaccactgaaagctcaattttttttccggcattgacagcttgattttatactgctccatgccatcttgtgtttcgtataaaaaacttattcttccttttttgttcagatgaacctcaaacacttctttacggcttaacatatatgttacttccttttgaatcaaatggctttcagaaggagcgccgtcaatataaatttcttttaaacgaaattgattcataccacatctctccgtaatccatagtcagttacagtataatgaaaaaatagaaattattaaatgtttcgctcatacaaaattctttagccccagcattgcaggattttttcctcgaaaacgtttatgttataatggaaggcaagaaaactttggaagtaatcggggtgagaagaaatgaaaacctttaaactggttgacctgaatgtggaacgagtggacaaggaagaacaatcaattgaacagtttccccttattgacggactgattataaataaagaagacggtgaaaatcactggctgattgaggcgcttgtacagaaagaacatctgtctttttttgaacagcttcaaaacagccaatctgaagccaaagtatttgtaacgatcacgaaaaaaagcaatcgccccgcccagctgacagcagcagtgaaaaatatcgtcaagctggaagaaagcatccaggttttactctacggacaaatggtcacaagaaaacagcagggcactgaaaccattctcgagtcccttgtaaaagagggctatacaggaacaaaactcattgaggcatttaagcaaaagttataaatatgagggggcatgttccccaaaacagacacagaaccgaagagcatcacaatagacatttagaatagatatgttctgcatgaaaagagctgccgttttgaacggcagcttttcttttcgtgctttcactcttgcatatttaatttgtatggccaaaagaatcaaccaattcccctttcacaacaaggcgcccttcagttttgaccgccttgtcacatgtgattaacgtaatctcttttttgttcgtctcctcaattacatctgcacccatttccgatatgatgtctttagatgttacagaatagatataatcctttttaaaatccgtgatgacaatttgggcacctgtttttatgttttccagaggtccgaacagaagattcttttgcttcaaatgatggcccgccaacggataatttccctcacccattttttgatccgggcgcattgttgccgcccctatcaaaagattttcattggttgtgccttttacaatcggaagctccagatcgacacttttaattgttatccgcccgataaccgctttttgatcgtgatcaaagccggcctttacagcatccattaactcaggcggctcgattgaatcaaattcaaattccgcttctctctcattattttttttcagctgctccacagttaaggccgattcactctggcttttgctaagataagctataattccacctttgatataaggagaagagatcagcagcagtccgaaaaggatgaacactgtaatgatcattttcttgtacatgcaaaaaaccctttcttatgcatccttctaaaaacgcttcgtgtcacttttcaaaaaagcacctgatcgattcttcgatgatcaggtgccttcaactttatccttttctttgtttctttcttgaggcaacagctaagcctccgcctgccataagcagcaggataccgatcattgctgtcagcatgctgtctgtatctccggtttttgggagggttttgtctgtgttcgactgaccatccgagctgccatctgtaccattggtattcggatgatctccatcatcttttccatttccacccggtgcaggtttatcaggatgatcatgcttatcaggcgttggtgttttcactttttgattagaaacaacgatctcaacagcttttgactgtcctttttcaattgtgaattcaatcggtgtttcgtcaagtttgtaaccttcgggtgccttcgtttcaatcaactggtagcttcccggcgcaaggccttttacagtgaactgcccattttgatctgttttccagagttcagaaagctcttttccatacccgtcagtttttacaggcttgccgctttcatccaataacttgaattcagcgccctccaaaacggtatttttatcgtcttgatccacttttttcacatttacgtcacctggtgccaatatgttttccgcggtgatttcgactgttttcgtgtctgtgtttgtgatcttgaacgatataggagtttggtccaactcataatctttaggcgcttttgtttcaacaaactgatattcgccagctttaaggccgtgcaccgtgatttgtcctttgtcatcggtaaccaaaccggacttcagcactttgccgttggcatctgtcaaattgaactccgcaccttgcagaactttatgctgatcatgctgatccactttggtgaggacaacaaggttcttcgtattaaccgctgttgctttcacttgctcaggtttgccgccatattctgctttaatggtgaatgacactggcttttcggataaaagatatccatctggcgcctgtttttcgataaattgatagcttcccggcgctaacccgtcaacttcaattttaccgccttcttttgagactagatcgtctctcactgttttcccattgctgtccgtaattttgaataccgcgcctgccaagccttttccatcttgatcttccttcatcagctgaaccgatccttgatagttcacggcgatcccggcatccgcggattttggctttcctgctgctgattcagaaatggtaaactctattttctccgtgttcagcacataaccgtctggcgctttcgtttcaacaaaggcgtagcgtcccggcgcaagatctgaagccttcacttttccgtctttatcggaagtcagctcttcttgaaccgtatttcctttttcgtcgacaatgttaaaaactgcaccttcaagcttcttgccttcagcattttccttcgtcaactcaatggtgcctttatggttagtagcgatcccggcatctgtagcttcaggctttccttcagaggaatcagagatctcaaactcaattttctctgtattcagcacatagcccgctggcgctttcgtttcaacaaaagcgtattgtcccggtgcaaggcctgaagctgtgactttcccgtttttatctgaggtcagtccttcttgaaccgtattaccttccttgtcgataatcttaaagacggcttcttcaagcttctggccatctgcatcttccttcgtcagctcaacagagcctttatcgttaacggcgattccagcatctgcggcttcaggctttcctgctgcagatgctgagatggtaaattcttttttctttgtattcagcacatagccggctggcgcttttgtttccacaaaggcgtaatggcccggtgcaaggcccgaagcctcaatttttccgtctttatctgaagtcagcttctcttgaacgatctttccatcttgatcgacaatgttgaatactgcgccttcaagtttctggcctttagcattttccttcgtcagagatacttttccttgataattggtcattgcccccaaattgacgtcagacacttgattcttttcattctttgcgattgagaaatgaatcgctttcgtatttacgataaagccttcaggagcttgtgtttctgtcaagcgatagtagcccgccggcaaaccgttcatttctacttttccgtttttatcagattttatatctgttcgtatgagagtataggtgccgtcatttgattttttctccagcttaaaaacagcacccgccaaaggattgttttgttcgtcttgtttgataagcgtcaccttgttctgttgatttacgactttgtacagcgctcctggcttggaggagttgctgtctatctttacagagactccttttgcataagcatcactgatggtatatccgtcaggagcttttacttcttttaatacgtaagaaccgtagcgaatatttccgaatgtaagcttcccgccggcatccgtcgtaccagtgcggaggagctgtttggagtcctcagaccataactggaattctgctccttcaagagctttatcgtcctctccagtcttaaaaatcgtcaggcttcctttttctccggatccggaaccgtcgccgcttgaaatggcaacaaagatcgagctgctgttttcttgagtctgctccttcacatttgttcctgaaatggacaccttatttttaacatggccgctcgtgccggctatgttaatcagagaccggtatttgatcacataggcgcgatcaatttgcttatagctgcctatgaatttcaggacaaacgattgttcacctgttgtattgtccgttttgatgtctaacgtgtagtctttgtttttttgaagctcgacatctcccgcggtcagatttccgctgctgtctttgaccactccgttttcatcatattttgcttgatatactttaaaagaatctgcatctagtatttgattttcatccggcgtgtcagtaacttttacgtcatccagcgttgattggctggagttgacattgatgttccaatcgatgtagcttccattttgtttgccgcctttgaaaaccaggcttcctccgttcgcaactgaaacagagcctgttaacgtgcggtctgcatagccgtcattatagtaggttgccttgtttgtgtactgattctgatcaatgacctgtcctttgagtgatgtcttaaactcaatcagatatggtacagaatcgcctgttttaaggtgtaccgtcagcgtgcgttcattttttgcagaaggctcttcgacatcatacttggaaggatcaagcgcgtctccttctgtgatggagccgtttttattgatcgtatagctcttaaccacaacggaacccggcacaaattgctgaggatctgttatggcatctttgatataagggtttttcgtcggctcgccattataattgacgccgattttccacgtgatttcctttgaaaccgcgttgtatgaaccgttcttgaaaccattgtttgtcgtctgattattcggcgtaaaaccgcttgataccttattcgtgcgctcattgccgttttgatcactccatgtcgactgagctgtattcttaacgctttcgttagaataatcggcattgaacgttgtcgtataagtgatcttaaattgactgtctgtttttgcataatccccgatcaatgccaaagtaaagcctttatgatcaggtttttttgttaacgtgtagtctttgtctttctgtaatgttttgttgttcgttgtgtcttgaagcttgaacgattcatcaagcagaaccattccgccgctttcaaattgatcatccaaagtccaattgttcatcaagtatttatttttattaactgtaatcgtccaatcaaccgtcttcttctcataatcaacgtttgaatatcctttgatgagattttgctgaatggctattccagaagcttcttttgaatcccctgttccggtcacaacgctattggtgtatgttgtagatttatcaatgatcactccgctgttgacctttgtttgatatgtgattttgtaagcgctcgttacgtttttattaaatttgacttcaaatccgcttccattatcgatgagcgtgtagtcctcgccttcctttaaaggcctgcccgcttgctcgctgccattctgaccaaaggtaataggaataaccttcaaagaatctttcacaagatgcaaatcaccagttccaaaagaatctttaatgctggccttggattggtcgatctgtttctcaccgtagttgtatgcaagagcccagctgaatgtttgagattctccatcatagccggtcgatgatttcgcgatcatttttccatacttggctgcaacagtggcttctgcagaaatgggttccaggttgtctccgctgaatgccgccttatttgtcagcgttatatttccgccttcactcggcttcgcaccattgtcaatgtcggtttcgtatacaaggcggtaggctgaatcaattgtcccttcaaatgtgacatttccttttgaatcaacactgtagccggaagaaacttcatttcctctgctgacagaaccatcaatgttcacattgagttcatacactttaactgaacggtagattacgccatctggaaggctttccgcgagtttggcatttttgacttgatccaactttttattgacatcgaccgtccatgttactttaccagggttgatgcctttatccagcacacctgatttatcaatggttttactcacattgggtttaaaataaactgttgtttcaggagtatcggcattcacagggaatggaatcttttgtgttgtcgaacccgttatttttttctcgttgaactgcgtattgataaccaatgtgcctttgacattagaactttcttttacctcgccgttaaatgtcatcaccacatgtccgttcgtatcaatagaaaatgtcccgtaggtggtgtctccggcgcctaacggcaggttcacaatgtcattatgcataataaattctttaggcaaatcaaattcatatttatcgccggcattgatcgtttttcctaaatcgtcaggaatagcccaatcaattgaaattttcaccggagaattcgtattggcgcgattgcccttgtcatatggctttccgttttcgtccgtcaacgtcacgccagttaaaatatgttgcgtgatttgtttttcttcagtttgcaagcttttgaaagctgattgacttgaggatgacactttttttgaatcatcactcttagaggcttcgccgctcttagagtcatctgacggctgctgttcttcctctttttgatccttgctgactgaaggtgcaggtttgtcatctttcccttcctgatcacccgcagtatcagaagagtcgttttttggctcttccgcctcggcatctggtgtctcctctttcttaacaggaatgatcacctgctgggttttgcctccgcctagctgaaaaagggctgctgctgtatgttcatcttcttttacatctgcagtaaacttagttggcagtgtaatggtccccttggcatcaagagaatccgcggatgcagttgttaattttactgtcatggtgctgctgcccgccggcacttgatagctgccgatgacctgatcagcagatttgatctcaccttcagcacctttatcaaatgtaaagcttttaggtatctccacattgatatcctgttcgctatctgcttttttgtcttttttcaatgaccattcatatgtcagtgtcacttcgtcccccggtgttagtgccggttcgtttccttttgatccgtcaactatctggcctttggcgtccttaactgttaccaaattgaaaaattggctgtcactggacgttacgtccacagcctgtgccgtaagagtatagctggcaatctggctgaagaagaaaaagatggcaaggcttatgatcataacgatccgcccgctttttttcagccctaagggaaaactcctcgttctcaacttttcattcctccctttcttatctatctttcacttgccgattgatccgcgagaccataacatcatgtctcatcccccaaaaagaactgctaataccgaatgagtttcaaaactaagatttaccatccgaaccaaactacattgtatgaaatggaactatacaatttctgtacaactcagaaatcatgtatgattgaagtgaattggagagagttgaagtttcacccaggagacatatggcgaaggccttccctttaagtgcacaaaaaaaccagtgtgcatcgaaaagcaatcgacacatactggtttggagttctttaattaatttgatccttcatttgtttgtaacgctgatattcttttatcgcctcttctaccttcccgtttttgttgaatagctgcagcttgtattgcataattttatgatcgcatggctcaattttctcggcttgcaggcaaatgtccatcgcttgatgatcgttcatttcatgaatatgataatcgatcagttcataggcctttccaagccaaagctgggaaagacgcgtcttttccggttctgcccaaagataaccgtgctccagtaggtaatgattttgataggacatgaaaatatccatgtgcagatgtaatgtagccgtattgagcggcggcgccccttttaatgatttttcccattcgacaacatcgatttttgcgcctgaaagccgaagaatatatccagtatcagtcttctcgatagtttggctgaaagggatctggctgaataattttcgtatttggtaaatggtggagtaaagttgggtgcttgcttttgaaacatcgtaatgaggccaaaaaagatcgattagcatgtctttactgaccacatggccttgattgtgaagcaaaaataagtatatttcacgtgctttcgacgttctccacttgactggaatgcttgttttgacatcctttaaggtttgatgaaactgcaagctcccaaagcattggatggaaaaatgcgcctcggtattttctgcattttgtctgagcatattattcgttttgattcgttcaacagttgtctcaagccgcttgtatatgacaggcttcagcaaataatcaatggcattcagctcaaacgctttgatagcaaactcattataagccgtgatgaaaacgacttggatgttttcattcatcgattgaatcgcctcagcaagctcaatgccgtttacccccggcatttcaatatcaagaaacaccgcatctacagcaggagtctcaggatgctctaaggcttcaactggatcttgatacgccataatagattgaaaggcgtttgttcgttcaagcattttcttaaaatgaagcaatgccaagtgctcatcatcaacaattaacgctttcacaaaacatcccaccctatatgtaaaatcgagatatcagtaaataacttctattatatcatgacaaataacccctttatctggattctttttctttctattgtagtttttgaaattttgcacttacaatatttataaaaaggtaggaatttagaatgagcctgcttgaataaaggagctataatatgaaagaaaaattcatctttacttcgattattttcggttacgctgcattttttatggttttcattgccattgaccatttttctggaacaacgcttcctgcggcaaggcatggggtcatgaacctggagaagtggaattttcagaaggatgggaatgtacagctgaacggagaatggacattgtatccaaatcagattctgtcaccaaaagagatcgcttcagcaaaaggaaaagatcctctcttcgttgatgtccccagcaatgtgaagctagccaagcagggtatcaatgtggattacggaacgtataagctgaccatcagatcaaagcaagacaatcaggtttttgggatcagcacgtcgtttatttacagtgccaatcgcatctattttaatggacaattcattggccaaagcggcaacccttcaaataaacctgattttgcggcacaaaaccgcccatatacgagcttttttacgcttcacaagggtgacaatgaacttgtcgtacaattttcgaacttcggaaaaacgccgggatggggaatcgcaaagccaattacttttggcacccaggagcaaatagtgcgggaaaacaaaatttcctttcttaatgatacaatcatgattacagcttttttcattaccggattatattttctgggctttttcctgcaaagaaaaaaagataaacatttgttgtttttttctgttatgtgtcttctgttttcgttcattattctgatgatcggaaaagagcggattatatttctcctctatccgtcaatttcattttcactgctaaattcattgagggcaatctctactgtgctcgtcagcattgcggtttttctctatctcttttttgcttacagagggattgtttcaaagcgttttattcgcattgccactgtttcttccgggctggtcttagtcacagattttttaaccgtgggttttatcggccatgcctcgtacatcttacattctgtgctagccgtctcgactctggtttatattacatatatttttacgattgctgcgatccgcaaaatggaaggaagtctgtatcttactattgcatctatatcaatgagtgcttttgtcattttaaccaccatttcagcttacagcggcaaaacggccttttcttttaattcgatttattcattgccaacagttatcgctttactggcgatcgttctgctgatggcgcagcaatttgccggagcattccgtgaaaatgaagtgctgtcgtggaaattgctcagaagtgaccggctaaaggatgaattcattgccaaaacatcacatgaattcaaaacaccgctgaacagcatcattaatatatgccagaccctgctggccggcaaaggaaaaagaacgatagaagaagagagagaaaacatgcagctcgtcatccgcatgggctacaggctttccaatctggtaaatgacatcctggatttagaaaaaataaagcagggcatgcttcaaatccacccggttcctgttgatatttatactttagtttgttcggaaatgaatttctacaatcttttatcgagacataaaaacttgaatatgatgaaccatatccctgacgatcttcctttagtgctcgcagatgaaaaccgcttccgccaaatattaaccaatttagtagacaatgcaatcaaatatacaacagagggccaaatcacactttctgcttcaagactgaacgataacatgatcaaagtgacagtagcagatacaggaagcggcatttcagaagccgatcgccaaaccatctttgagtcttttcagcaagccgaaaagaataaagacgatggtgctggtcttggcctcagcattgtcaaacagctggttcagctccaaaacggagatatttgggtcgaatcagaagaaggaaaaggttctgcattccatttcaccttgccgatcgcccaaaatgaatctgtctctgaaacaaagaaacgtcttcctgaattacaatccgagagagatctatcagatatctcatttagcacgccttattactctgtgcatattgacgctccaaccattctgattgtcgatgataacattgacagtttaaaaattttaaccgatatgcttgaaggtgtgccctacaatgtgattgctgcgaagaacggaaaggaagcattagaaatcatctcttgcacaaaccttgatttggttattttggacttgatgatgccggatatgactggtttcgaagtctgtatgaaaattcgcgaacgattcagcatggttgatcttccggttctgatcattacagctgccattatcgcccatgacaaatacaaggcttttcatgccggagcgaatgacattttgcaaaaaccttatcattactctgaatttatggtgcgtattcaaaacctgatcatgatgaaacatacagcaaatcaagcaactagaatggaaatggcgtttctccagtcgcaaatcaagcctcattttctttataatgtattaaacacgattatttctctcactcatttggatattgaaaaggcccgggaggtaacagaggaatttaccaactatttaagaatgagttttgactttcaaaatacatcagccatcagttccttcagacatgagctttcgattatcaattcctatctttctatagaaaagacgcgattcggtaatcggcttgaggttcttttcgatatagatgaagacattgactttatccttccgcctttaatgattcagcccttggtggaaaatgccgttcttcatggtgtcagcaagaaaagaggcggaggatggatcaaactgacagctaaaaaacaaagcaaaaatgagtatcacatcaaagtagaggataacggtcccgggataactccggaaaaacaaatagatctcttatcaacggattttgatcgcagcgtcggattgaaaaatatcaatcagcggctgaaacatttttgcggaagcgagttgatgatcagcagcactccggatgcaggcacctctgtctcaatgctcattcatctcgctgaaacaacaggaagccctaaagaactgaaggacacagaacgaacctaaacgaaaattgagataaaaaaagacgccgtttctaacggcatcttttttattccggcgactttgcttgctgcttcagcaggtctctgatttctttcagcagctcctcctgcgcatccaccgcttcctccgcagcctcttcttctgctgcttcttttttgcgccttaacccattcaaagtccgaatgacgataaaaatggagaacgatataattaagaagttcacaatcgtctgtataaagctgccatacttcactacagcatcgccaaacgtaaacgacaggcctgaaaagtcaagccctcccagcagcaaaccgaccaaaggcataatgatatcatttactagagatgtgacgatctttccgaaagcgccgcctatcacaacaccaatcgcaaggtctacgatattcccccgcatggcaaaggctttaaattcattccacatacaatcacctgcttttctatatttgtaaagaaaaaaagacaaatgtgccgctggccatctgccttttttcaattattctccgagggcaaaagtcagttctacttcgcaaacgacttcgccatcaactgtggcaacgccttttccgcgcccgattgtgccgcgggcacgaatgatttcaacctcaaggtgaagctggtcaccaggcttgacttgttttttaaagcggcagttatcaatgcctgcaaaaaaagccagtctgccgcggttttcttctttaatcaacatcgcaacagctccgacttgagcgagtgcttctacgattaatacgccgggcataaccgggtactgaggaaaatgtccgttaaagaactcttcattagcggttacatttttatagccttttgcccgtttgccctcttcaacttccgtaatccgatccacaagcaaaaacggataacggtgaggaataatttctttaatttgctgagtatcaagcattgtcttgacatctccttcatctgcattagtatgtatagcaatcatcaaagatccaatctgtacatttgaaaagtatattatgaattaatctctttttcaaccgcgctaaaatgtaaccaactgtcaatgagagccgtcaaaagttatgatatgataattatagattttaccaatagcaaagaggtaggaaaatgatttcgaagtttattgaaaaaagaatgctaaacatgttagacgagtggtattccgcaatgagcaaacgcaaaatgaatcacgtttgcacactgaaagagaaaattgaccagcaccttccgaagatcaaaaagaacacaaaactttggatgcgttatcaattgtttcaggcccgccatcagctgctttttgaaaaccagaacggactcgattcattgttcgatgacctatatggcctggaagacaaaatggatgatgaattgaaatattatctgtattttttctctgggttatatgagatggtaaaaacagctccgaaacatgcagtacatcattttaaaaaagctgaacagtacctggccgccattcacaatacgtttgaagccgctgatttatattatcaaaccgccggcgcctattacttgatgaaatcaccgccgctttccgtccaatacgtcaaaaaagcattacacatctatttgcaccaattcggctatatcaaaaaggtaatcacctgtaaacttttgctcgccgtgaattatattgatcaagaacgctatgaaaaagctgaacagcttttcaaagaaatcattaagaaaacccagcaactacatgacgaaaacctgctatgccatgcttattataaccttggctttttaaaagcgaccgagaaaaaagaccaggaagcgcttctttactttaggaaagtattaaagaatcaagaatttgaaatgaattcaccagtctcatatcttcattgtgtgtacgagtctgtcagagcgctttttaaaacaggaaacatcacagaagctaaagccgtccttcaaaaaggaaaagaattatctgaaaaggtagacattcaaaccatttatttaaaattaaaaacgcttgaagccctctacacctcagtggaagatccctatgagcagctgctcgaatatgtgcttgaattagaaaaaatcgaggcgtgggtggatttagaagtgctgttagaagatattacggaatactacaaaaaaaaggacgatttcgaaaaagccgctttttttatcatgcgcggctgattgaaaaacgcccattttcttattatctgactgaattgattaaaccgagcatttgatctcccattgtgatcgttctgctgttcagctgatatgaacgctgggacgtaatcaaatctgtcatttgttctgaaatatcgacattggacatctcaagtgagccctgctgcatgccgatgttttgtctattagcgccgttcagctcttcaaaagctgccgcattatcaatagagaaaaggttattcccttcggatttcagctcttgagggttattcacttggacaacgccaagattaaaccgctgaaccgcgtttccgtcagatgcggttaaggtgccgttcttattgatggtgatattcttcattgagctgtcgatgttcactgtattgccgttctcatcaagtacgggatacccatttccagtgacgagctgcagctggttggcattattggctgaaggcgttaaatataatgctccgtctctcgtatactggcggtttccatttacatttacctgaagatactggtatggagacgtaaatgcgatatccagatcgcgatcggtcttctgaatgcttccttgatcagagactaggcgtgaattcatcatcgctccgacgccaaggcgcaagccgggcggcgtttttcgggcttttgccacttcctcgtttttttcatcaacctgatcgaattgctgtctgacaagctcagaaaaattcgtatcttttgccttatagccggttgtgttgctgtttgaaaggttgctgctgattgtgtcaatctgctgctgcagctggtttaaggttgttgatgccgttagcattgacctgagcatagttgatgtcccccgttttttcttccgttatcttaaatttttccaatttcatttgctgctttatccatacttttatcgtaagcctgaataaccttctgattcgcctcaaacgatctgtacgcttcagtcatttctgtataggcgcttgtcacatccacgtttgaaagctctgagacgccttgttttaatgaataggatacctgattatttccggctgcgcttggcagatcattaccgtccgccgtgctgtacaaatcatttccgtcccgtttgagattgcggacatcttccgccattctgacatcaatctggccggctgtgcgtccgttcgttgtcacagtaccgttttcagacacagtgaaattctcattatcaacagtgattggctggcgatccgtcgataaaatagggcgtccgttgatcgtcagctgattgttctcatttagtgaaaatgtgctgctttttgaataacggattccatccgctgtttgaaccggataaaacagagcagctttttcattggtttccgcattcatcggaacttgattttcgatcaatgcaatgtctgtaggctggtctgtggacttcaggcttccctgtgtaaagagaggcttgagctcctgcatatatactccggtattcacggaaccgatttccgcccttgatgtcccggccggagattttgattctattctgctgagcagcatctcagggaacgcgcgcatagagccttgatcagctttatatcctgatgtatttgcgttagcaatattatttgaaagcatttccgttcttcgctgctgggcaatcattgcggatgttgctgtatataatccttttaacaaatttcccacctctaaaaatggcattttttccagttgtcatataggaacgttcgttctataataaaaactcagtattttatcctattatcgtcatttaacatcttttcgtgaaggctttttcataaaaaaacctcattctttttcagaatgaggtttgtgaaatcagcttagtttgcgtttaggaagcttgtccatattatcaagcatgacacctgtgccgatggctacgcaatccataggattttcagcaacgaggaccggtaccttcagctcttcagcaagcagctggtcaaggccgtttaagagcgcgcctccgccggtaataataacgccgcggtcaataatatcagcagaaagttcaggcggtgttctttcgagcacttgtttcgcagcctgaacaataacagcgacagattcacgaagggcttcttcaacttctttactgtttactgtaattgttcttggaagaccggaaaccatgtcccgtccgcgaatggaaatttcctcgtgacgtgcgtctgggaaaacagttgcgactttaatcttaatatcctccgcagtacgttcgccgatcagcagcttgtactcgcgtttgatataatttaagatttccatgtcaaacttgtccccagccattttaatagaagaggaggtgacaatatcgcccattgaaataaccgcgatatccgtcgtcccgcctccgatgtctacaaccatgttaccgcttggctggaatatttccatacccgcgccgatagcggcaactttaggttcttcttcaaggtacacatgtttcccgccgcttttttctgcagcttctttgattgctttttgctcaacggatgtaatattcgtcgggcagcaaatgagcatgcgcggctttgagaacaggccttttacattcagcttgttaataaaatgtttcagcattgcttctgttacttcaaagtcagcaataactccgtctttcagcgggcgaatcgcaacaatattcccaggtgtacgtccaaccattcgtcttgcctcttcgccaaccgccagcactttgccgctgtttttatcaagtgcaacaacggaaggttcattcagaacaattcctttacctttaacatggatcagtacatttgcagtaccgaggtcaataccaatatcccttgcaaacatctatttatatcctccttgaaaatctgtttcacagtaaatatccacattgtgccctaattatatatattatcataaaatatagaaaaaaagttggaagcacaataagttctttacaaatttttgcggatgttttatgaacgatttcaagaaggcaatgccaggtgattacgattgctgaacaggctctccttcgagaatttcatcttttttatatttgagctttgtcgcttctcctcctcttaaatgcctgatggatttatgataatcgagtatttctttcacttcgtttgccaagtcggggttaatttcaggcagacgctctgttaaatccttgtgtactgtacttttggaaacaccaaattccttcgcaatgacacgaacggttttctttgtctccacgatgtacttccctatcttgattgttcgctctttgatgtaatcgtgcacaccactcgacctccctaaaatggatgtgagaagtgtgaaatgagatccgtattctgtaaagagtcgttcattatgccgcttcttcgttgtatggttttaaaagtaagtttgtgaaatatgcccacgatccctcacctcaaacactctctttgttaggtttgtaacagtgtattagcattcttttgggaatatgctaaaaactcaataaggacaaggggtgaaacgaactttttcagattcagcaaactatttcgcgtcactaaattttcatctttacaactattgatcgctcctgtaaaatgaaataagcaattagttacttaggtaagttttttagaaggagaccgacatgtcctacgtcaacagacacctcattcatcaaatcaaccaaagcgcccgcctgattgccaagaaagccaatgaacagctagagccattcggcctttattcatctcaatggtcagttttatattgtttgcgtacgatcggaccaatgactcaaaaagagatttggtcctatttaaatgtggaagcgccgactgtgactcggacgatcaaacgcctggagaagaacggctgggttcagagacggcaaggtgaagacaaacgggaaaaacttgttgtcctcacaaaagaagccgagaaaaaatacgaagaaatcaatgtgaaaatgctgaaattcgaggaagagctgcttgctgatttccgggatgaagataaagaagctttttctcatttattccgcatgtttttacaacaatgaaaataaggaagtgacatacatttgaaaaaagcggatgcgatatggaccaaggattttattatggtcctgcttgtcaatttatttgtgtttgtgttcttttatacatttttaactgtattgccgatctatacgctgcaagagcttggcggcacagaatcacaaggcgggcttttaatcagcctgttccttctgtctgcgatcattacacggcctttctccggagccatcgttgagcgtttcgggaagaaaagaatggcgattgtatcaatggcgctcttcgccctatcatcttttctgtatatgccgattcataacttttccctgctgctcggattgcggttcttccaaggaatttggttcagcattttaacgactgttacaggtgcaattgccgctgatattattccagccaaacggcgcggtgaagggcttggatactttgccatgtctatgaacctcgctatggcgatcggacctttccttggtctgaatttgatgagagtggtaagctttcctgtattctttacagcctttgcgctgtttatggttgcgggcttacttgtttcgttcttgataaaagtgccgcaaagtaaggacagcggtacgactgtattccgttttgcgttctcggatatgtttgaaaagggcgcactcaaaattgcgacggtcggtttgtttatttctttctgttattcaacagtcacatcatatctgtctgtattcgccaaatcagttgacctttcggatatcagcggatatttctttgtttgttttgcggtgacaatgatgattgcacgcccgttcacagggaaattgttcgacaaagtcggaccgggcattgtcatttatccatcaatcctgattttctctgtcggactctgcatgctgtccttcacacatagcggcttaatgcttctgctttcaggggcggttatcggtcttggctacggatcaatcgttccttgcatgcaaacattggcgattcagaaatctccggctcaccgctccggttttgcgacggcaacgttctttaccttctttgacagcggaattgctgtaggatcgtatgtattcggattgtttgtagcatctgccggcttctctgccatttatttaacagcggggctgttcgttttaattgctctgcttctctacacgtggagccagaaaaaacctgctgaggctgaaggaaaagtgtctattgcagaataacttgtcagactgccgggaaatcccggcagtcttttttccattaaaacacggcgccctctcggttgaacgagagaacgccgcttatagcaattattcaatgacaggccgcgcaggtgaatcaggatctaacgaaaaatcataggacgcttcatcacgaaacatcggatcggcatatatggattgttgatcgttttttgttgcttttcgatacgaagaaaatgaatcatattctttctttttccacatccatatgccgtcttgatccgcttccttgtggtacacgttatgattgaccgtattaccttcgttttctgtaaagtcgtttccgataaataatctggaatcaccggccgtcaatatattcttttcaattgtgttgtttttcgtatcgtactgcagcagcagctgtcctccgtacagtccctttgtgtcattccggtacataatattgcgggcaatcagagaattgctggtgccgccccgctttttgtcatatcctccgattgaaataccggtgtacgcattgttgtacactttgttgtctgtgatctgaatggcatttgcatactttcctttgtgttcagacgttgcttcaatcccaatatcgttatcgtaaactgtgttgttcttaatttcgatatcgtgtcctccatcgacataaatcccgcccgctgagtattcatctccataagcaggattgccgtaagtcgagttttgataaactgtattgttttctacgactccgtttcgcacgtaatcgtttttatccgcggttccctcataaccaattagatcaatcccgatgttattattgttgcggaccacattgcctgcaactgtgaagccgtcgatattaccgttcagcacaactgcttcactcgctccaagcgtcagtttctcaactgtattgtcctcgattcggatgtctttcatgctgccagtcccataaactgcgattccgtgagcatttccttcatccgctgttgtcttaatcccccggatgtgattatccttaatggcgatatgactgctggaccctgatacataaatccctatagcagttgcttcctcagatgaaacagaaagatcttgaattgttaaaccgctgatggcaatgtcatgtttatcgtgaatacgaataagcggtgtttcatattcagcgttcgcaacggattcaccgctaatcacgacgttttcattttcatagtttcggaatgtgataggctttccgtccgtaccgctgtgctttacatcaagggtctcatgatacgtgccctcccgaatcatgacagttgtgccggcagcagccttctcagatgcgtgtgccaatgtacgaaacggcttttcttttgttccttcattttgatcactgccatttggcgaaacatacagataatccccagatccttcctcattcgcttttgtcttatcataaacgaaagcgaggatgacagacgttaaaacacccgccaaaagaataaaataccattttctcattttcgattcccatttcgttttagaatagatttctaaaaccattataaatgttctatttatggaaaaccatttcaaaaatatgaaaatataccgtctaaatagatcttattcagcctggcggacctgcgcatgttcaactgtttcaattgccaatgatgcaggcgggtgaacacgcatcagaacaatgtagaaaagaaaggaaatcagcacacctacaaaccaagaaatatcgtataagctcttcaatacaggaacatacatgccaatcagcgaaatcagcgctcctaacattgtggctgcaaacgcacggtaattgtagcccttccaatacacataccgtcctgtttcggaatacaggtcatctaccgagagctcacgtttgcgaatgataaaatagtcggccatcatcacgcctgccaccggtccaagcatgccgcctattaagccaagaaacgcatacacgcttgtcgcgctctccatcagcttccatggaaccgtaaataaagcgagcaacgctgtgataaagctgccacgtttgaaattgatatatttcggcagggcattcgctatatcataagcgggcgatacgatgttcgccgcaacatttacagagatcgtggcgatgcagagcgtgatcacggacaagacgatgacataagggttatcaaaccgcgccaaaatatcgacaacatcccaaatcggctctccgaacgcgacctgcgagccggaggtcaccgtaatactagcgaatgcgaacagcgcaaatgttcccggcaaaccgtaaaattgtcctttgatttgctctttttgtgtttcagcaaaccgtgtaaaatcaggtatatttaagatcaatgtcgcccagatgccgatgatgccagtaactccggcagcaaacggccagaatgtttctgaaaacgtatgaaactttcctggttgagagtatatcgggcccaatcctccggcaatatcaacggcccaccataccatgccgccaaataccagatacactaaaggccctgcccacacctcaaaacgtttaatcgactccatgccgtgatgcaatacgagtaaatgaatggcccaaaagaatacaaaggaaagcaaaccggacaagtgaatgccgagaatgttccactcgccgccaatttctccccagcctggccacatattcaaaagcaaaatgttcagtgccgtgctacccgcaaaggtctggatgccaagccacatgatagctgtaaacgcccttagaagcgcggggatattcgcgccgtatatcccgtaagaagcccgaatgatcacgggaaacggcagcccgtattttgtccccgcatggccgtttaaggcaagagcgccaaataggataagtgatgccgtaataatgatcgccagcacctgccaaggcgaaaggccgatcgcaattaatccccccaccgtcgcgtaggtcggtatgttatgtatacatcccatccaaatggaggcaaagttcattgctttccacgtccgtttttcctgtcccaaaggcaccagatcttcattgctcagcctgttggattgctgctgactctcttttaatttcatagccggctcccctttccatattgtctatatgtcatcacgttatgttttttgacattagatgtcacttaatataactgaagagtcagacaataacactggctatgatatacaattttcccgtttgtatttgaacagcttaaacaagaaaaagagacagacctcagagcccgcctctttcttaagatgcagttttcattaatgcagcaaacctcacagccattaacaggcttgctccgcccgctatgatcataatgattcccatcatatcaaaatgggctgccgtgatttctttaccaaaaagaatgccaaggatcaccgaagacaaaatcgatcctaggtaacggcaggtttgaaacaggcctgaagtcgttcctaccatgttggaaggactcgttttcagcatcgctgcctgaagcgcgacattgctcagtccgtagcctatacccaagagcgacagaatgagccctttaccgatggtctggacattgataaaaaagatggttaagagcacggctccagccgtcatcaaaagcgctcccgcaaagatcggcttgacgacaccagatcggtcgatccatttgccggttagaggtgacacaacgatgctcattccagacataaacagcataaacaggccgctcgtttgaacagaaagatgcatttcatcctgaaagtaacttggcaaaccaaaaaataaacaatagaagaaaacattcaataaaataaactgaacatacacggctgacaggtttcgctgtgttttaaacagacggacatcaataaacggcttatccgttttcagctcgcgccagacaaacgcacagagcagaagcaagccaagcacaccttcaaccgcatgcggcgacgtgctgaacgacagcaaaaaggatagaaggaaaatgattcccccggcaaataaaacaattccaagaatgtcgagctgctgaataatggttttgattcctgccccttttttctgatctttcgggaacatatacaggcccaataagaagctgaggataataaacggcaaattaacgataaagatcgccggccagcctccccatacaatcaaaaacccgccgactgtcggccccagcgccgtcatggctgacgcaaaaatagagagtacagccaaggctgaagcttggcgctcatgaatatgattccgaatcaagccgacacctgacggataaatcgcactgctccccaccgattgaaacagccgcatgaccaataatgtcataaacgtcggcgcaaacggcgccccgatggcagaaaccgcaacaagaataagcccgaataaaaacaagcgtttccgcccaatcaaatcaccgagcttccccgttacgggctgcgctacggcactcgccaagtaaaacgaggaaatcagccaggaaaccgttgtaaacgagaggtgaaactcatgctggatgctatggagcgcaagagagatcatagacgagttcagcggattcagcattgttcccgaagccaccgctgttaaaaaaacagcccggctttttttcgataacatcatttcacttgttccagaaactcttccgttgtccgcgatttaccgattctcgggaaaataaagcgcagtgtggcttcatgctcttcatcgctaaatgtggacatggcatctgtaataaaaatctgctgatagccaagctgaaatgcctcccgtgctgtgctttccaccccgatattcgttgcgatgccgcacaatacaatcgtatcaatgccgcgccgtctcagctgcaagtctaaatctgtgccaaaaaaagcaccccattgccgttttgtcacagtataatcgccatcctgcacacccatttccggaacaaattcagcccagtccgccggcatttcccctgaacctccctgcgcaggctcatccgtttgcggcttcagggcgtccgctccatcatgaaaggctacatttacaaagctgatgaacccgttatgtttccgaaattcatctacgagctttctcgcgttcgggacaacctggccgctttgatcaatcggcacaatccccttttgtaaatcaatgatgaccaatgctgttttttgaaaatcaatgttgagtgtattcatcatacgtctcctcctgatactgttagtgtttctcacattgcatattttactcttcacactgcctaagttcttttatgatgcttgtgaaattctcagaaggaacgttttctcatgatttttcttttatgtagtagtaacaggttgtgcatacgaacaaaccggcaagcactgtaatcataaggggcgtcatcgcttcatcacctgcctgctgtctatcggttcctgcctgaaaatgcccatgaatttgcggcggtccatccaaagcaggataagacacataaccattaatatcgtgctaagatcctgcacgccaatatcaaaacaatagttaatcaagacgatgttcacaataatgggcataaaaataaccgcccctaatgcagccgttcgcggaatcagtaataaaacagctgccaggatttcaccaaaacctataaatagttcatagacatgagaataaccgaaaaatgtccacgcgatcgtaaacccctccccggcagccgcctcgatttcaggcgtcacctcgccaaactggccaatcaccactttcgccagaccgtacacgaaaaaattaaaggctaaaaacaatcggaacgtcgcgggaatcgacttgcataatgctctcctcagcctgccgcctttattcatcatacatccccctcagtgtattatttgatatagtacacttaatacagtatagagtattctaattaatgtcaattcccttttcagctcaaatgaatagcttcttttatagatacaaagtcttatatcgtaaaaaatgtcgttctcctttctttccgtccctcgataacatttcttaaaaaccatgtcaggaaatcttacatgaaaatgttttatcattcttttttctctataatgaagaaatataataattgcaatttaattctgaaagatacggaggaatgagacatgcaaatgggcgatacagtttttatgttcttttgcgctttactcgtgtggctgatgaccccgggattagcgttattttatggaggaatggtaaagagcaaaaatgtgctgagcactgccatgcacagtttctcttccattgccatcgtttccatcgtttgggtgctgttcggatatacacttgccttcgcaccaggcaattcaatcatcggcggactggagtgggccggcctcaaaggggtcggatttgatccgggagattacagcgataccatcccccactcgttatttatgatgttccaaatgacgtttgccgttctgactacagcgattatttccggggccttcgcagagcggatgcgattcggcgcttttctattattctcggttttatgggcctctttggtttacacacccgtagcgcactgggtatggggcggcggctggatcggccagcttggagcgctcgattttgctggcggcaatgttgttcatatttcctccggtgtggcaggacttgttcttgccattgtgctcggcaaacggaaagacggtacagcgtcttctccgcataacctcatttacaccttcttaggaggagctttgatttggttcggctggttcggctttaacgtcggcagcgctttgactttagatggtgtagccatgtacgcgttcatcaacacaaacaccgcggctgcagccgggatcgccggctggatcttagtagaatggatcattaacaaaaaaccgacaatgctcggagcggtatctggcgcaatcgccgggcttgtcgccattacgccggctgccggatttgtcacaccgttcgcttccattattatcggcatcatcggcggagctgtttgtttctggggagtattctcgcttaaaaagaaattcggatacgacgacgcgcttgacgcctttggcctgcacgggatcggcggcacatggggcggaatcgcaacaggattattcgcaacaacctctgttaactcagcgggcgcagatgggttattttacggtgatgcaagcttaatctggaaacaaatcgtcgccatcgccgccacttatgtttttgtatttattgtcactttcgttattattaaatttgtaagcctcttccttccccttcgcgcaactgaagaagaagagtcacttgggcttgacttaacgatgcacggggaaaaagcatatcaagattctatgtgaggagtgacgctatgagcggtcaaatgttcaaggtagaaattgtaacgcgtccggcaaattttgaaaagctgaagcaggaactcggaaaaatcggagtgacctctctgactttctccaatgtacacggctgcggccttcaaaaagcacatacggagctctatcgaggggtaaaaatagaaagcaatgtatacgagcgtttaaaaatagaaattgtggtcagcaaggttcctgttgatcaagtgactgagaccgctaaaagggtgctgaaaacgggatcaccgggtgacggtaaaatatttgtctatgaaatcagcaatacgatcaacatccgcacaggcgaagaaggacctgaagcactttaatatcggtacgagattcggacactccggatctctttttttgtgcacagaatccccccagaaaccgcgattcctcttcgaattctcttcaagcgccgttatttcagacaatctctatttttatttgaaacttttcatgagtaagattagtctactaaatataaaaatgtaaaaggtgattatttgaactacgaaatttttaaagcaatccatggactatctcatcacaattcagttctcgattccattatggtcttcatcacggaatatgccattgtcgcctatgcccttatcctattggcaatctggctgtttgggaacacacaaagcagaaaacatgtgctatacgcaggcatcacaggaattgcaggccttgtgatcaactatttgattacgcttgtttatttcgaaccgcgcccgttcgttgcgcatacagtgcatacactgattccgcatgctgcggatgcttcatttccaagtgaccacacgacaggtgcattagcgatttctattgcgatgcttttcagaaaccgcaaaatcggctggccgcttgtcatttttgggcttttgacaggattttcgagaatttgggtgggacatcactatccggtagatgtattgggcagcctcgttgtcgccatcattatcgggttccttttctttagattttcagatctgcttcgcccgttcgtcgatttgatcgtgaggatctatgaagccattatcaataaactgacgaaaaaaccaaccgatcaaaatttctaagaaagacaaaagccggcgtctgaaatcaagacagccggctttaatatttctcatacatctcttgttttcttcgcttcgccaacacatataaaccataaaacaatccaataccaacagcatcgatgagcacatcccggatacaaccattcctgctgaagaagagctgaagaacttctgtgaaaaaagcaaatgcgaacgagccggctgcagctgatcttatgctgccccgctgtttccacagcaaatatgtcagcacaaagaaggaaaacgcgtgcccgattttttgaataaacgcttcaggtacagtaagctcagtaaaatccataactaaaaattgagacagatcagggtgcggctgaaaatgaaaagccaccgtttgcgatacgaccatgccgctgaagctttccgtacagacagaaagcaggataaaaaatatccagcctgcgagcaataggcggttcatgacataacctcctttataacgtacgtgcctacatgtaactacatagacggtaaaacaaagcaaaaagtaacagaaaaaaacgcccatcacaaggatagacgttttcttcattaagactgttcagtgtcttctgttgtgctgctttctttggaaccagatttgtcagtggaatcatcctttttctcaccggatttttcttctgttcctttttcagttgatccgtcctttttctcggaagattgctgaatggattcttctgtttcttgggtggcagctttttcttcagcagctgctgctttttcaatagaagaaactggtttgtccataaagtttaacggattcattgcgaccccatctttacggatttcaaagtgcacgtggtttccgctgtcttcactgtaaaggttcttgccagattttccgatcacttgattttgttttactttgtcaccttgctcaacgcttacttcggaaagagattgatacacagtcgataaaccgtcggcatgttctacttccacaacatatcccagcactggatctttttcagctttaacaaccgtaccactcagagaagcagagacatcgaaatcttttccgtctttctcagctaagtcaattcctttgcttaggctgtacgtgttattataggtaacgagtgctgcttctttctcttcttttgcggcatcggtttcatagaactttttcacaacagaaacgttttcagaatcaacaactggcattgcgacattttccattgactttcctacttcaactgcatcgtcgttgttgtcatatgcggagtttccgccgttatcagccaactgatcctttacctcatcatttgatactgattgataccaaaggacagctgttaaaatgacggccgcactgactaagtaaattgcagggaacacccagcgtttacgaaaaaactgctgaagttttttgacttgagaagttttcttttcttcctctctcattgtttcatcacctcagcaacattctgaacacttttctgaaaatatatacaacctatccaaaaaaacttttttagatgtagtttgcacagactgaacgaaaatatgtattttttttgagaggagtgccaaaaacgtatgaacatgacattgcgtcttgctgaacataaagacttggaggctgttgtggcgatttataattcaacgattgcttctcgaatggtaacagccgataccgaaccggtaactcctgaagaccggatggaatggtttttgggacatacagagtcacgcccgctctatgtggccgaggacgaaaacggaaacgtcgctgcctggatcagctttgaaacattttatggaaggccagcctataataaaacagcggaggtcagcatatacattgacgaagcatgccgcggcaaaggtgttggatcatatttgcttcaagaagcgctccgcattgccccgaatcttggcatccgctcacttatggccttcattttcgggcataataaaccaagcctgaagctgtttgaaaagcacgggtttgcagaatggggactattccccggcatcgccgaaatggacgggaaaagatacgatttaaaaattttagggagagagctttcatgattagtctggataaagatgaaaacgaaattgaacatcataatgaagaaaatagccttgttgaacaggagactgcacctgttgaacaggagacccgccagctgagcgcctccgctgtcaagtcgctatccgacattgccaagtggggcaaaatttctggcatcttgttaatcattatgggatcgcttgtcactctgtctgctttgatgacagtgattggcgccatcccgggcgtactgctcattatatcaggcgtatttttgatgcgctcagcaaaagcagccgcggaaaccgaaggaaatctagccggcagcgctggcgaaagcatgcttgaaaattacgggacatttataaaaatgcagctgttttatgcagcatctagtatcgttactgtcctgatcgggatcattgtagccattttcgtgctggtggtaatcggcattgctgcttttgagaacacgccttcgtatgaagatccggattcttattattatgaggatgatccggtgtttgaataatgatgagacaggacagggcatgagttccatataaacggaaccatgcctattttatttgactattcaaagcaggccggcgtaaacaccaaatcctgaagcaagcatacaatagacatctctagtagaggaaatcaacaaagcaacgctgttacccagaaatgaatatcaaaaaaacggatgaagtcggaatcaatccgaaaccgcactttttatttcgggtgtctgcatgcaaaaaaacacacctggatcgtctggaaaaactcaacaatccgggtgcagctcttctttaatacatttttttgcgtctgtcttcctcagtcaaaaattcaacaaaactccgcatcgcaaaaggctcttcctttatttgtcgtgcgtaggagcttttccgctcttctgaaaggatttcgctctttttgatcctgttcagcatatagatgtgaaccgttttttggatttgtttatgctgatagcctgcctctttaaaaaatgcgagcccgagcgccgccaaaagggcgaatatgcctgcgctgatcagggactccctgtcagctgaagcatgaaatagaaaagcagctaaattaaagagagagaatgcagcaagcggaatagcaagaaaacggtaaatgacggtttttttcatgaaaggctgtacggccttttgaattttttgcatttctgttttgatgaaccccggcatttgttcgactctgtaaaagttcatataatcctccccctttatttgatgtttcaagcttcacgaacgttatcatatgtgtttattttaacgcaggtgcaagctggttttaaagaaatctgcccgtatttttcacgaagaatctggatcgccgctctttattcttttaaaatgtgagtgttataatttgtaatgggaatcagatcactgttattcatggaatactaatggcaatcttcttgataaatatgaatgagcggggttacaaagtgagtatttcttccatccttttatcactttttttcattttaaatattcttttggccatcattgtcatcttcaaagaacggcgcgatgccagtgcatcttgggcgtggctgcttgttcttttctttattcccgttttaggctttattttatacttattattcggccataatctcagacgcaagcatttgtttcaatgggaagaccggaaaaagattggaattgaaaggctgctgaagcatcagcttgaagatttagaaaccaagcaatttcagtttaacaaccgggcaacctttgataacaaagatttaatttatatgctgattatgaataaccatgctgtgtttacagaggataattcagttgacgtcattacagatggacgggataaatttcagcggctgctgagtgacatttcaaaggctaaggatcatatccatttacagtattatatttataaaggcgatgaattaggcaaaaaattgcgggacgctctcatccaaaaggcaaaagaaggtgttcaggtcagagtgctttatgatgaactcgggtccagaacgctgagaaaaaagttttttaaagagcttcgcgaggctggcgggcatgtggaggtctttttcccgtcaaagctcaggccgattaacctgcggctgaattaccggaaccatcgaaagcttgtgatcatagacggtatgaccggttatgtcggaggctttaacgtcggagatgagtatctagggcttaatccgaaattcggttattggcgggatacgcatatccggctgcaaggaacggccgtacacgccatccaaacacggttcatccttgactggaaccaagcttctcatcaccatacgctgacatatattccaaatcactttcctgattacggcccaaaaggcaacgtcgggatgcagattgtcacaagcggccctgattcggaatgggaacaaattaaaaatggctacatcaaaatgatttcgaacgccaagcgttccattttgatacaaacaccttattttatcccagatgcaagcctgctggatgctttaaggatcgcttgcctttcgggcattgacgttaacattatgattccgaacaagcccgatcatgcctttgtatactgggcaacactttcgtatatcggcgatctgctgaaagccggagccactgtctatatttacgataacggctttattcacgcgaaaaccatcgtggtggatgacgaaatcgcttcagtcggcacagcgaacattgatgtccgaagcttcaggctgaattttgaggttaatgcatttatatacgatatcaccattgctaaaaaactggtttcaacttttaaagaagatttgctagtatccagaaaattcacctatgaggagtatctgcagcgcccgttgtggattcgaataaaagaatccgtctcgcggctgttgtcgccgatcttataagatgtgcaaacccccggcctttacggccgggggttttcctgatggtcacagtaaatgatgatcgcctcccgcaaaaaagcggcaagaccttctccatattgattgattgaatcggtaaatcgctcgtcagtgatatacacttccccgagtcctctgaaaatgtcgagtgtgcaatcgtaatgatattggcaaatatgatcgcgaaatgcccccactgcggcctgaacctctgcatcatcgggcccatgcttcattcgcgccgcaattcgtctgtaaatcgaatcaaattcagccatgatcgagcgccaatcatctgccgagtatgcagatgtccttttctctgtttcttctgcgatttcctttccatacagctttctgacttcatcagcgtatgtctgctggtgctcttcaatgtctttcatgcttaatccggcaaataaatctctcttattcatcgtttcccctccatcaacggacaaaagcgtcctgtcaattgtttgaatcatctcatccattctttgttttttcttcatcaatatctccttttgcgactgaagtgccgctttccggtcaaaattcggatgatccagcatctctttaatttcatccaaacgaaacccgatttccttgaaaaataaaatctgctgcagtctttccaggtctgcgtcactgtacaaacgatacccagcatcagtaagcgctgaaggattcagaagcccaatattgtcatagtgatgaagcgtccgaatgctaacgcctgatatctccgccacttgtttaacttgatatttcatacataacacctcctcttttttatcgtaaacaatcacgcaacgttagggtcaatccccaaaatgttattttctatatacaaaacttctcacaaatagtgtataaaagaaaagtgagtatttttttgtaaaggggagccagtatacatgaatcctgaaacaatgaacaaaaccctcatcagcatttcgaaatggggaaaagctacaggcattttatttattattatgggcgcaattaccgcgctttcaggcgcgttcatttttctaatcggtgccgtgccaggcgtactgcaaattatttccggtatctttttgatgaggtcagctagggaagcaggccaaatggctgaacacaatagcggacagtctgaagacttaatgctggagaattacgcgaaattcgtaaagatgcaagggatttatttgatcgtaagcattgctgtatccattcttgcgattatcgccttcttcatctttttaatgcttgggattgctgacggccttttcagcgatacgtacagcacttattaatgagaaaaacccggagctggctccgggttttttattattccgcttcgcttaccactgtgaagcgttcatttttgtgttcgggatgttcaagctcgtccaacacggcaatggcataatctgcatagctgatatagctgtcgccttttgcatttacgatgacattgtcttttcctttttggtaagagccagtccgttttcctgctggatcaaaaaatgctgcaggactgaggaacgtccaggaaatgaagtctgtctgctgcaaatctttcaggttctctccttgatttgatgcagttggcaaatattctttcggaaattccggcgtatccattaaacgggttgttttggcttcatcaacaaacaggcttcccgctccgccaacaacaagcaatcttgtgcgcttcgcgtcctttaagatgttgatgagtgctcttcctgcttcaacatgaagatgttcttggccgggtgctgctccaaaagcgtttacgactgcgtcgaaaggcttgatgtcttccgcagtcagttcaaacacatctttttccaaaaccgctacgtcctgcccctgcacttttgaagcgtttctgacgatggctgtcacttcatggcctcttgttttcgcttctttcaaaatttcgtttcccgctttcccgcttgcgcctataataccaattttcatttttcatttcctccttatttgtaacaattttagttacatgttagcggtgagaagtcatcccttttgattaaaagagatgattcataacatcttttaatgacttgcttgccagttcattttccatcgctctttgcacactttcaaacgtttcatccagagcgttctgaatttttttccctaccggacatttcggattcgggttttcatgaaccgcaaagagttcttcttgcttttggacagcccggtacacttctaaaagagaaatatcagcaggatcttttttgaggcttgcacccggcacccctgcgcgtgatgtgagaatatcagcttttttcagcaggctgatcattcttcgcacaactaccggatttgtgttgacactgtcagcaatgatttctgaagatgttttttcatccatcgagatgagggataaaatatgaatggcaacagcaagacggctgttaatcatgttttttcaccaccgttgtaactataatagttacatttaattcgtttgtcaacatctaatatacactaaatacacgggttttgtgcaccgtttttagtcaatagaacggccggatgcactccggccgcgtcttatcaaaataagaaatatctttgtccaagtgggacataatcgacaggctggcaagacaattcctccccgtcagcaaagacctgataggtttttggatcaatctcaatctttggcaaagccgaattcagcttcatatccagcttgctcagctttctgatatttttgactggagaaatccttttttccagccctaagctttctgccacaccacgctctacgcttgcctgagacataaatgtaatcgaggttgagcggttggcttttccgtaagaagcatacatttggcgcatgaaaaccggttcaggagtcgggatggacgcgttcggatctcccatttgcgcacgtgcaatcatgccgccctttaagaccagttccggtttcacgccgaaaaataccgggtcccacagaacgagatcagcaagcttccctttttccaccgagccgacctcatggctgagcccgtgcgtaattgccggattaattgtgtatttggcaatgtaccgttttgcgcgcacattgtcattcccgttttcaccggcaagagcgccgcgctgttttttcattttatcggctacctgccatgttcggatgatcacttcaccgacccgccccatcgcttgggaatccgatgatgtcatgctgatcgcacctatatcatggagaatatcctccgcggcaatcgtcgccgccctgattctggaatggctgaatgccacatcttcaggcactttcgcatctaaatggtggcagaccatcatcatgtcaagatgctcatccatcgtattaacggtataaggaatggttggcgttgtagatgacggcagaatgttcgcgtaagaggcgagcttcataatatccggagcgtggccgccgcctgccccttcaatgtgataagtatgaatgacccggtccccgatcgcgtcgagcgtgttttccaaaaagcccgcttcgttaatcgtatcggtatggatggcaacttgaatatcagcctcgtccacgacttccatacacgttttaatggcgcttggcgtcgtgccccagtcttcatgaagcttaaggccgatggcgcctgcttccacctgctcgatcagcggcgctttatcggatgcattcccttttcctaagaagccgacattgatcggaaactcctcggccgcttccagcatcctcgccatataccacgccccggacgtacatgttgtcgctttgcttcctgtagcgggtcctgttccgcctcccaaaagggtcgtcacacctgaagaaagcgcaacttccatctgctgaggacaaataaaatgaatgtgcgtgtccactcccccggctgttaaaattttgccttcaccggaaatcacctctgtccccgttccgatgaccatgtgcggatcgactccatccatgatatcaggatttccgctttttccgacaccgacaatccggccgtctttcacaccgacatccgctttgacaatgcctgtgtaatccaatagcacgacgttggtgataaccaaatccaaagcgccgtccttccctgtgattctgccgttttggcccatgccgtcgcggattgtttttccgccgccaaagatcatttcttcaccgtatactgtgaaatccttttcgacttcgatccataaatccgtgtcacccaatctgattttatcgcccgttgtcgggccaaacagctccgcatattcctcccgtgacattttcatcggattacaccctccatccagccggcttgttttaagttggccaacgttttttctttgccgcgttcatcgataaacgtgtcggccattccgttcagccctctaattgtcttgcgtcctctgatttccactagtgagaccgttttctgctctcccggctcaaaacggaccgacgtgcctgatggaacatcaagacgcatgccgatcgccagctcacggtcaaataataaagccccgttggcctccgcaaaatgaaaatgcgaaccgacttgaatggagcgtgatccggtgttttttaccgttacctcccgtatctcacggccttcattaatcgtaatggttccctcagcaatttgaaatgctcccggcttcatgacttcacctccgcagaaattggctgatgtaccgtaacaagctttactccatccggaaatgtggcctccacctgaatgctgtcaagcatctcaggcaccccctccatcacatctttttccgttaatacatggcggccggcttccatcagctctgctactcccttcccatcacgtgcgccttccataataaagcaggtgatataagcagcagcctcaggatagttcagcagaacgccccgcgcctttcgctgtttggctaattcccccgctgcaaaaatgagcaatttttcttgttcaaccggtgtcagtttcatctgtagtcctccttcttttgtcatataaagcagatgcggctactacgaatttgcggaacagtcaggcgggacatcacctccctttcttcgagaatgggggtcatacggtaagatgcctttcaaagcggcatgccgtttcttcatcagccttgccatggtcaacaaccgttcccctgtcgatcacggaaagatcagattaacgcgttttccagactgcgctcgactaagataacaaatgtctttttttctggaaatttctataataacttgtctgactagttcgacaattaaaatctgaattccttccaattgtttattaagtaaaatatttttcagatttaccatcagcgctctggcgattgcaagctgctgctgttggccgccttttcgctttgaacaaacgtttgattaaaataaatagcccccctgtttagccggaagcaggcctatggagtggatggccgactccatttcggcctaatacagcgacaatctgccccgggcgaagctaaggctgtgcaaaaccatcgattgatcataaccagacgttacattcctgatggcagcccgttgttttgctccgcaaccggaagcatggcatggaggccagtctgaggcgccgacctccacgataccgagaacccgactattgccattaactccgcatcatggacggtcacttcgctgatcgccaccgttcctcttaatgagtgaagaattccggccttcactgaatccccgcttgtgtcgatatcaactgttttctcgcactcccgtggcttccgacactttcttcggtgcagtacattccgtcatcaaaacccctttgtttgatttctccaaatgatgttataaaagtttacaacttatgtcatcattatatagaagaggcctattaattcaaagaatatttaaaaaatttagttaccttgaccaaatcagcttctttttttgttatatttattcacatcagaaaaagcgaaaaaaaaaagacaagaaacatttcgtttcctgcctcttccgtacgattaatctttatctgaaaatttatccttggctttcccgatatccttttggatttcgccttttgccttatcttttttgccttcagcctgcatgtccgttctgtcagccatatctccgactttatccttcacttctcctttggctttattaaagccgcccttcattttgtcttttacactatcgttacccatgttaattctcccctctcaattatgtgtgtacttgttaccttcccgatctgagaggcaataaacattctaatgttatttatcgatttcgtagcgctctccgtaacggagcaccttgtatattgccagcccgtctgatgactttttctccgaataccggaccggcagcagggcaaaaaacacataatacgtagaaaaatagacaaactgatagaaaaacacattcggctttaatacactgtgtataatcagcagattgattgcaaaaatcgtgatgaggttaaacaagcagccccctgcatacacgagtgcatttgagaatcgattgtcaattttcaactccccgtaccggcaaaaagaatcgataaaataaatcgttctgaaccgtatgggtccaattttaagcagcgtttttcccatgcctatatccaacgatccttttccgccaaaaataaaagccataaagctgtgccctgaaacatgtataatctgtacaagcggcagaacaatgaggaaagaccacagaaacttcaccatatcattaaagccaaacattgaattccccctcacatgcatatctgcaccccaaaacggcttttgttcaaaaaacagtgctgtagcgattattcctgttctccccggaaataaacgttccgatgctcccctttttttgcataaaaaaaaaccatctgccagcagatggttttgtctcatacttcatataaacaatcgttcctttgaatcatctctctcatgctgaccgctttttcataaaaatacaccgcttctttatattgttcgcgatgactgaaataggaggcagcatctaaagcaaattcttcaatatatacgtacaggcccttttcttccatataatcaaatacttcttgaatcatatccaaattgacagattccacatataatgcctgcagaaatttatattttgccagactgaagaagtcgtttcgtttttgggcaatggcaatccctttttcatagtaccgcatcgcggcttggcaatcttgttttttgaaaagaacgcgagtcaggctgaagagcgcttttggaagctgttccagctgataatcctcgaagacaggaagcgctttttcaaagtattcggcggcctgatccagctcccccttgtcatcatagcaattaccaatattataaagggctgatccgatcaaacggggctgtccttccaataaagcaaggcgatacgcgtcatctaaatgttcaagcgctttttcataatttctgtagtcaatgtagtttcctgatatgacgaaatggcattgaattcttctgactctgtaaaaatcgtgagccttatacgtctccagcgcctgtacggcatggttcatggaaaagtgcgtctgcttcataatataaaagacttccgccactttaaaatgaaattccgctctttcaatttcatcttctacaaacgcaagcatcttctcagctttccgataaaaggatatagccgagatgtaattgttctgttcaaattcgtacattcctctaaacaagtgaaaataatactcagataatccggagatgctgtcctgattgctttccagcgttttgatcaattcacgatattgaagctgagattcctcgtgcaggtcaggctttacataatccagcataatttggtgccggtagctgatcagctgataatacaggagaagcagctgatcctcttccatctgttcgatatctagatcaatttcttctttcagctttacggcatcagccacttgaaatgctaaaatgtgcttataccacttattgattttcactcctacttgagatgacgggatctcgtacgcggccatgcccctccaaccctttctattttctaattggttatattttatcataatgtatggctttggaattaaattttcttacaatgattccttctttatgcctatccttatatatttcggtttttctacgtattttttgcactcggattctaataaaaaagcttaccggacagtgccgataagcttttgacttcaaattaaccgccaatataagacatttccactttctttttgccagatgcttttgatagcgtacgatcgactgaatactgatcgatccgatttttccatactgtcccgatcatttctgatagttcgtcatcacttaattcctggcgaaccggagctctgaggtcaaatccgcttgaagcgaataagcaggtaaacagctctcctctcgcagaaagacgggctctgttgcaagatccgcagaatgcatcagatacagatgatatgacgccaatttctccggagccgtccaagtagcggaatctggaagccacttcgcctatataattaggcgctatcggctcaaccggcatgtgtttattgatcaaatctatgatttccgcctttgtcatgacgtctttcttttcccattggttggtgttgcctacgtccataaattcaatgaatctcaggatatgccctttttctttaaaataacgggccataggcagtatatctttttcattgacgcccttttgaacgaccatattgattttaacaccgagccccgcttgcttcgccgcttcaatgccttccagcaccttgctgacagaaacaccgcgcccgtttatcttcttaaaacgctcgtcttctaaagaatcaaggctgatcgtaacccttttcagcccagcctccttgagcctcttagcataaacaggcagcagtgatccgtttgtcgtcatcgcgatgtcacgaatacccggtatgcgggccagttttttgattaattccggcatatcctttctcatgaggggctctccgccggtcaagcggattttttcaacgccaaatcttgtgacaaacaatgtcgcaagccgttccagctcctcaaatgaaagcagctcctctttctttaaaaaaggataatccgggccgaataattcggcgggcatacagtacgtgcatcggaagttgcagcggtctgtaacagaaatgcgaaggtctctcagcggtctgtttcttttatccaacatctgacgcgactctgtaatcatagctacagccccttcctactccctgattctctcagggtgtgtatatacattaaatgatccgtttctgacaaatccaatcgctgtgatattcaattcttcagccatttgaatcgcaagctccgtcggggccgatttggaaatgacaatcgacacgccgattttggccgcttttaacaggacctctgatgagattctgccgctgaacacaatcagtttgtcgcgtacggacatcccgtttagaaggcagtgtccgtatagtttatcaagtgcgttgtgccgaccgatatcggtgcgcatcaacagaagcttctctgtgtcgcaaagcgccgcattatggacgcctcccgtatcctgaaacgtcccgctcccttgctgcatgtctttcataagcgccagacatgcctcaggcgatatcttgatttggctgacagccgtcttggctgttttgacatcctgctgaaaataaaaatgacggccctttccgcagcatgagccgatcacccgtttcgtataatccttttgatccaatgtctcagggtgaacgaggtcgacatatacaaaaccgagactttcatctattgtaaaccttttaatttctttttgaaatcgtataacaccctctgatgcgagaaatccgatgacaagctcttcgatatgctcaggcgtacaaacgagcgtcacaaattcactgccattcagtatcactgtcaaagggaattccgtcaccatccggtcttctactttgcttatttccccttgttcatagcgccatacatccctgaccgcagttactttatcgttcaatgtctcttcccctccgcaatgttcctgcctttatattttttcacactcctcggattttgtcgaattctgagacacaaaaagagccctctatataaagggcttttacaggatgtgatgacggcggtgtttaggcagggcgcctaagcatttagccgccgttccttttaccaatgtgcattgacaacgaacgcggggtttgtcgacacgctgagagccctctatataaaggactctatgtttgattatgctgattctttttcagaaccgtaaacagcacaatagctgcgatcaaggtgagaatgctgacaaaaaagaaggctgccagttttagaagaacaccaagcaatatgaatgcaacggtggctataagaaaaatcattccgaataatttcatatgttcaacccctttttagggtatcattcccgcccaaactgtttttaaaccaataaaaaaggcgcctgggggagcgcctgatctttaggttccttactcagtaaatttttgtgcttctttttcccaagcctgttcgaactcagccgcactgttcgctgaaatatattctccgccgccagcgacagctgcttgtttcatctcttcattacccttgacatcaaagttgaagccaatgatgtttacaatcgtatccacatttgatgcacggagcttttcgatttctgccgcagggtctccgccgcacgtttcttcaccgtcagtgattaaatacaccacgtttttcccgtctgcgtcaaatgcctcaaattcttttcttgtgtctgcaagtgctttggcaatcggtgtccatccagtcggcttgagctcactcaatgaattgtcaaacagggatccttcatatggatgaaggccgtaaatagtttccgtcgtactgcacgaaagggctttaccggacagtttattattccctgcatgcccgaaaacgcgaagcataagatttgtatccttcggaaggagttcggcaaaagattttactgattttttggcaatgtctattttgcgctctcctcctgttttttgaaccatgcttccgcttccgtcaaacaaaacagctacatttgtatcagcctgtttctcagcggcaaaagacggggaggcaatggaaacagtcaacaatccaatgataccggcagccagcaattttttcatatgattacttcctttctttttcatattttccaactatatgttggattcttctttatgctagaatacgaaaatgcaaaaagatataggacatgctgccttttgtgctgctttcacgatctgtccaaaatcgcttgaaatgccgttcatttttagccatttccgcccagaaagcataaacagcttgtgtgatcattcattcttttttcgccttgattatgacagaaaaacggaaatctgctactatgctacaggcagacagctaattagttttgaagtttttgttacatacaaaaagaggctgaccatcaccagcctcttttttcttatttagataacattagtgattgctgagtgaaaattttctcaacatctttttgggtataagccgggaagtattcaccgccgcctactttcgcaattgcgttcagctggcctttgtatccctctttataatcaaatccgatcacattaacagtgatattgtctttttgcagttcctttgctgttttaatcgggtttcctccgcacgtttcctcaccgtctgtcaacagatacaccactttttccccttttgcatcaagctggtcaaaagaagatttcgcttcgttcagcgctttggcaattggcgtccagccagtcggcccaattgtattgagagaattgaggaagctttgctcgttaaagctttggaagccgtatacgttgcgaatggcttcacatgactgaacttttccggaatttttattgtttccttcagagccaaacacgctcattttcacctgagttccttctggcaatgagctcgcaaactttgaaatttcttttttggctgaattaaatttagatacaccgtctattcttttcgccatacttccgctggcatcaagcaagaccgccacgttcgccggcgctttagcctccgtttctgtcttttcagctgcaaaagcaggtgaagttaatccaaatagcaatcctgtcatcatgatcagtgaaaatcttttcttcatgttcgtacccctttaccaatttgtttctgcgtgcagatgttcaacgctgaacataatctatcgtaatcaacaaaaaccgagaaataaatagggcgggcttccccattgctgttgtttacttttgcatagaaacctatgtttttattagtgatttccacctaacgcccctatgaaaagagaagattgtccgcctttcggctttcgttatatgagtctgtcgaagtctgtcgacaaatgtggatgactttaccacaatctcaaagcctgaaatcaggaaaaaaggactgatccttaaagacggtcagaagctcctctaaaccgtttcagctgctcttagataaaagatattcaggaacagaaaaagacgcccaatgagcgtctttttctactttttcgccatatatttattcaaaaacgaatctgcctcagaaatttgtgtgccttggtaataatactttacaatgtcatcaaccgttttgccttctttcgccataaaattcgctccgtattggctcatccccacaccgtggccaaatcctctcgtcgtgactgtaattgtgtctccatttcgcttccattcaaaatctgcggagttgagacccagcttttcacgtatgtctcttcctttcagcgtcttgccgttaatgacggcagttgcaacctggtggcccggtgtctcgccggtaatcttccctactgcgctagatccatccagcttgacgccaagcttttgctgaaattctgccgctgtaaaggttttcgtttccttatatttcggagactttttatcccatgggcttttgacgctttttaaatatgggatagcacttgtccaatatgcttctgcattctctgtgtagccgttgcttgtggagaaaaaggaggcttcaatcggctggttgttgtacgttaagattttgccttgcgtactggctaccgcagctgtgattttcttcagttttgtctcatagcttgtgccccactgttttttcagctccgctttgtttttatacacctggaacatctgtgtatcatccaccagtgagcctttaggagcctcaaccgctgaatttgacaccatcagtctgacaataaatgttctggcggcgagggcctgggctttcagtgcttcagattcaaaggttgccggcatttcggaggcgacgactccaatcacatactcttcaagcggaatgtcttctacggattgatttgcggttcgatagacgggaatagaaacaggtgaagctttcaatgtttctgctcctttcgatgctggtttcgtgctgactgctgtcttttctgattctacgctggcccccgcttccttattatgctggaatggtataaccaagagtgtgggaaccaagagaatcaatgcacatagtacggatagtgtgattgcgaattgtttcatattcagctgcctcctgctcgggattcgactctagtctagtctatgggcagggacaagctaatatgactctcgttttggacagaaactttatttgtcatttacgtattcttttttgctattttgcgcataatgatgataatacacaaaaaataaaaaaccagtatgccagagtgacatactgattttcaagtaagtttatgcatttaagtcagaaacgacttctttattctcttgctcagaagcagactcatcatttacacgttcgatgtctgcgcccagagcggcaagcttctgatggaaatcaacgtaaccgcggtctaagtgcttcaattcagtaacacgtgtgtgaccttcagccactaaccccgcaagaatcagcgctgcacctgcacgcaaatcagtcgctgcaacttcagctccctgaagctgtacaggaccgttaatgatgacagaacgtccttcaatcttgatatcaccattcatacggcggaattcttccgcatgcataaaacggttttcaaaaacggtttctgtaatcatgcttgtgccgcttgcacgaagcagaagcgccatcatttgtgactgcatatcagtcgggaagcccgggtgaggcattgttttgatgtcaatcggtttaagttctttcgggccgatgacacgcagaccttcaccttcatccttaattgttacacccatctcttccatttttgcaattaaagaggtgaggtgctcaggaaccgctccttttactaatacgtttccttcagtgattgcagcagcaaccataaatgtgcccgcttcaatacggtcaggaataatatggtgttttacgccgtgaagcttttcgactccttcaattttgatggtgccggtgccagctccgcggatttttccgcccatgccgttgatatagtttgctaaatcaacgatttcgggttcttttgccacgttttccagcgttgttgttccttcagctagagcggctgccataatcaggttctctgtagctcctacacttgggaagtccagataaatttttgcgccttgcagtcggccttttacttcagcttcaatgaagccattaccgactttgatttctgcgcccattgcttcaaaaccttttaaatgctgatcaatcggtctggaaccaattgcgcatccgcccggaagtgcaactcttgcatgacctgtacgcgcaagaagcggccccatgacaagcacagacgcacgcattttacgaacatattcaaaaggtgcttcagtttgcaaagcgtatgaagcatttacagtcacttcattattttcaaaatgcacatctgctcctaaatgacgcaacacttcgttaattgtatatacatcggagagcgtaggtacatcacaaattacgcttttttcttcacttgctaataaagatgcagcgataacaggtaaaacggcatttttagcgccttcaactttgactgtgccgtttaacttctgaccgccgcggacgatgattttttccaaggtattcccctccgcgtccctaaattctctatattaatattcagtcgtaacgattggtgtgccaaccgtaacggtatgttttccgcccattcctgcacttctaagtgcaatttgcaaattcattttatgtttcgaggtcataatgtactcttcccactcatctgtaaacgcagaaatagaaacgaaatttggctcaactacatgttctactgatcttgcttgaaattcatttaataactgatttgcttttttttgcaaaacaatattcatattatcatctaagtgaccatttagacaagtaaaaataactactttttcttggaatatcccaagtgtctcccgttcaaactgttcatatgtatcattccagctatccggtgtctctagactcatttgctcatataataaatacgaagttggattgtgttttttgagggttgtgacaagctgcagtctaaaagaagtacgattttttttgtcagtatatgtgccaattgcctttatcattttatcttcccgtgcaatcacccaatcatattgacgatactctgattttaaacgttgcactttttgataaaattctttttcggtcagtgacatgttttgttttgcatgcaatgtccacttatctattgacacatcttggcgttccatcccctctgccatttttgctaacggcgttaattcactcgcatgaatggtatggaaaacagcaatgacgaagcttaacatgacggaaatgataatagcgtggcttacttgttttttcttcatgttcatctctcccccttatccccagttttaccggaggcaagaggcgccatacgtaaaaatcttcgtcaaaactcgagctattcgcctcaacccgcttctcccaaccatttaatgataataatgttcaaaacctattaaaatagatagggaagctgctgtgaataattgaggtaatctaaaaagaaattggcaacggccgttccaatggcgattgtcagcaaaatcatcaggagtcttgcctgcacgactttgcctttttttattaacggatctatattgacggcttgcaacgcccaccaagtcactgctataaaaaacaggtgaacgacaatgccgattgcagcctgctgtcccaatacactcatctattacactcctttctctgcgttcataccctttcttattatataagaagcacagataaagatgatacattttatacagaacggaataatcacccaaatctagggctaatccccgcttaaagtgcgattcttttacatggtatactttattggaaaggagctggcaaatgtgaatcattctttttttcagcctgaaaagcaatatggtgaggacctgccaatttttgatcaggaatgggaagcaattgcattctattatgattatagacagtcacagattgaagaactgaatgaattgtgtcagttttttaacatttctcttacctatacgagagaaagccttgaagagcttgaaaacctctattttcaaagtatacaagaacttttgcttgctgattggaatcttcctattgaagaattcgagaaaatgatcagtgtttatcttatagattgtgtgattgcccgccatgaagatgctgaatgggttgtaaaaccttatccctataaagacggcgcttatacacttggctttagaagacatcgcaaatcgtggcatacaatgaatgcctgtgatggtttatacctgcgccaaaaagaggatcgcccgctgctgtcgctgtttgattctcttgttcgttcataaaaaaatccttctcataaagagaaggattttttcttatttccctgctacatccaatctgttcaaagcccgctgtaatgcaagctcagcccgacgaatgtcagtatcatctgattgagtattcaaacgctcctgcgcccgctggcgtgcagcttcagcgcgctctttatcgatgccttctgctgtctcggcagcctgggcaaggatggtgacctgatcaggacggacttcgacaaatccgccgctgacggcaaccatttcagtctgcccgtcttttttcagacggacagcgccgattttaagaggagccacggttggaatatggcctggcaaaataccgagatcgccgctttcggctctcacactcaccatttcgatatccgcatcgtatactgggccgtcgggagtaacgatattgactttaacggtcttcatgcttttaccctcctaggaccagattaaacttctacacccatttcttttgctttctcaacaacttcttcgatacggcctacaagacggaacgcatcttctggaagatggtcgtatttaccggctaagatttctttgaagccttgtaccgtctcttttacaggcacgtaagaacctttttgtccagtgaactgttcagccacgtggaagttctgagaaaggaagaactggatacggcgtgcgcggtgaacgacaagtttgtcttcctcgcctaattcatccataccgagaatcgcaatgatatcttggagctctttgtaacgctgaagcgttgactgtacttcacgcgcaaccgcataatgctcttctccgacaatttcaggagcaagggcgcgtgatgtagatgccaacggatcaaccgcagggtaaatacccatttcagttaatttacgctcaaggtttgttgtcgcatccaagtgagcgaacgttgtcgccggcgccgggtcagtgtagtcatcggcaggcacgtagatcgcctggatagatgtaactgatccaacgttcgtagacgtgatacgctcttggagctgacccatctcagttgcaagcgtcggctgataaccaaccgctgaaggcatacggccaagaagggctgaaacctctgaacccgcttgtgtgaaacggaaaatgttatcgatgaagaacagtacgtcctgtccttgtacatcacggaagtgctcagccattgtaaggcctgtcaaagcaacacgcatacgtgcgcccggcggctcgttcatttgtccgaataccatggctgttttgttgattacgccagagtcactcatttcgtagaaaaggtcgtttccttcacgagtacgctctcctacgccggcgaatacagagataccgccgtgctcttgcgcgatgttgttgattaattcctggattaatacggttttacctacaccggcaccaccgaacaatccgattttaccgcccttaatgtaaggagcaagcaaatcaacaactttaatacctgtttcaagaatttcaacttctgttgaaagctgatcgaatgaaggcgcctgtctgtgaatcggatcctttttcgcatccgcaggaaccggctcattcaaatcaatattttctccgagaacgttaaatacacgtccaagtgttacatcaccaaccggtactgagattggcgctcctgtatctacagcttccataccgcgctgaacaccatccgtagatgccattgcgattgtacggactgtatcatcacctaaatgaagagcgacctcaagcgttaaatcaatacctacttcgttttcacttgcagctggctgtgaaattttaatcgcattataaatttcaggcaagtgaccgtcttcaaaacgcacgtcgacgaccggtcctaatacctggctaacgcgtcctttcttcatcgctatccctcctgacaaaatctttctattctaaagcggctgctccgccgacaatttccgtaatttcttgtgtgatggctgcttggcgagcgcggttgtaagaaagcgaaagtgaatcgataagttccttcgcgttgtctgtcgcgtttttcatcgccgtcattcttgcagcgtgctcacttgctttactgtcaagaagcgcaccgaagattaagctttctgcatattgaggaagcaaaacctccagaacctcctcttcagatggttcaaattcataagacgccgttctttttccgccgccgctgcccaaatcagataacggcagaagttttttctccgttacttcttgagtaatggcgctgacaaaatggttataaacaaggtgcaattcatcaaacgcaccgtctataaacatttgaatcgtttgacgggcaagatctttaatttctgtaaacgttacttcatctccaagtcctgttaactcggaaatgatcggaatctcccgtttcttaaagaaatcacggcccactcttccgatggcaatcaccgcatactcatccttagactgatgacgttcttgcatggcctgataagcactccgtaaaaccgaactgttaaaagcgccggcaagaccgcggtcagacgtaatgacaaggtatgccgtttttttcacttctctgctgagaagcatcgggtgcttcacgttgccggaaactcttccgacgtttgacacaacctcttggattttatccatatatggcacaaatgattttgcattgttttcagcacgattcagcttagccgcagataccatctgcatggcttttgtaatctgacttgtttttttcgttgacgtgatccttgacttaatatcgcgtaatgaggccaaagatttcaccaccttttctcttcatctgcgtaaaaagagagaaaaagagaacctttttctctcatcagcattcgagttagttgcttggtgcaaatgtgcgtttgaagccttcgattgcagctttgaagtcttcatcagcaggaaggtttcctgttttcgcaattccgtcaagcaggtctttatggttttggtcaaggtacatgtagtactcttcttcaaaacgtctgatatccgccacaggaatatcatcgagatatccttttgtcagcgcataaagaatagctacttgcttttcaaccggaagcggcttgttcagatcctgcttcagcacttcaactgtacgcgcaccgcggttcagttttgcctgagtcgcttggtcgaggtcagaaccgaattgagcgaatgcttccagctcacggtatgacgcaaggtcaagacgcaaagtacctgatacttttttcatcgctttgatttgcgctgagccgccgacacgggatacagacaatccggcattgatcgctggacgtacgcctgagaagaacaaatcagattgcaggaagatctgtccgtcggtgatggaaatgacgttcgtcggaatataagcagagatatctccggcttgtgtttctacgaacggcagagctgtaattgatcctgcgcctttcgcgtcgctaagctttgctgcacgctcaagcagacgggaatgaagatagaatacatccccagggaacgcttcacggcctggcggacggcgaagaagcaaggacagctcacggtaagcggccgcttgtttagaaagatcatcgtatacaacaagaacgtgcttgccgttgtacataaattcttctgccattgtaaccccagcatacggtgccaggtacagaagcggtgccggctgtgaggcagacgccgttacaacaattgtataatcaagcgcgccgtgtttacgcaatgtttctactacgccgcggactgttgattctttttggccgatcgcaacatatacgcagatcatgtcttggtctttttggttcaggatcgcatcgatcgcaacagatgttttacctgtttgacggtcaccgatgatcagctcacgctggccgcggccgattggaatcagtgcatcgatcgctttgataccggtttgaagcggttcatgaacggatttacggtccataacgcctggtgcagggctttcaatcggacgagttttgcttgtaaggatcgggccaagtccgtctaccggttggcctagcgggtttacaatacggccgattaactcttcaccaacaggaacctccatgatgcgacctgttctttttacttcgtctccctcacggatctcactgaaaggtcctaagatgacgatacctacgtttgattcttcaaggttttgagccatacccaaaacaccgtttgaaaattcgacaagttcaccggccatacagttgtcaaggccgtgcacacgtgcaataccgtcaccgacttggatgactgtacctacgtcttgaacttcaatatcagattgataattttgtatttgctgttttatcagcgtgctaatctcttcagctttgatgctcacttaggtttcaccccttctatcgattttccccggctaattgacgttcgatgcgctgaagcttcccgcttacgctgccgtcataaatccggtttccaatgcggactttaatgccgcctattaaatccgtctgcacttcatttctgattctcagtgaagcgactccggctttttttgcaaacacttgtgataatggtaacatttctgcatccgtcagcggtttcactgaatatacgattgcgtcttctgtttgacgggccacatttgcgagtttgataaactcatctgtgagctcagggacaatcgcggcacgatggcggtcaatcaaaagaaaaatcgtattgagtacggactgtgacaaagagccaaatgcattttgaatcagctcttttttcttcgcagccggcaccttcggatggttcaacacatcattaagcgctttttcattttgaaatacttgttttacaacaattagctcttcttctacttgattcagctgagcggactcattggctatatcaaaaagagctgatgcatatcgtttagagacagctgatccactcatcggctttctcctacctctttaagatagtcctggatcaatttctcttgcgcttgttcatccagttctttttcgatcactttcgacgcaatcatgacagaaagagacgctacttgctcacggagagcagaaaccgcctgttctttttccttcacgatttcagttcttgctgcttctttcagacgttcagattctgcacgtgcagcctgaataatctcttctttttgcttctctcccagtttctttgcgttttcgataagagtttgggattcctgtcttgcttcttttaaaagaacgcgctgctcttcaatcagctgctgcgcttctttatttttttcttcagcagacgtaatttctccagcgatgtggtcttcacgctgtttcattatgtttaatagcggccctaaagcgtatttcttcagaagcgctaataagattaacatagctaacagttggaacaggatatctccgccgttaaacgacaatcctagttcaagtggtaattgagacatctactacggcaactcccttctgcaggtttttctttgctgatccagcagccgcacttgtctcttttcagccggcaaggcgggatgcttatcagacataaagcaatggcgaaggttctcttggaatgatcttcgccatttttagttcatataaggcttttatgcttagccaaagaacgctaagaatgcgataacgacagcgataataggaagggcttcaactaatgcgatacccatgaacataagagttctcagttctttacctgcttccggctgacgggcaatcccctctaccgtacgtgaaacaatcaaaccgttaccaatacctgcaccaagtgcgcctaaaccaattgcaatcgcagctgctattaaattcatgaaaaagttcctcctttaaaatgttatccgtttggatataatgttttaatgatcatgactgattttatgagacatgtacaccatcgtcagcattgtaaagataaatgcctggatagcaccaataaataaactgaatgcttgccatgccagcatcggcagaatggcaccgattgtaccgacaagaccgagagccacgctttgcgaataatggcttgttgctaatcccgcaagcaggccgagaagaatctcaccggcgaagatgttaccatacagccgcaaacctagagtcagcgtattcgcaaactcttcgatgattttcatcgggagcatgaatggaacaggtcttaaatagtctttggaatattccttgagccctttcatcttcacaccatagtagtgggttaaagcaacaaccatcacggctagcgttaatgtaatggcaggatcggctgtcggagacttccaccagagctcatgtccgattgtaatagagaacggcagccccagcatattcgacacaaatatgtacatcagcaatgtgacaccaagtgccaagaagttagcccctgtttttaaatccattgtactgccaataatattgcggacgaaatcaacaatccattccataaagttctgggcttttccgggacggatcgaaagcgttcttgtcgtcaatatagcaatcaataaaacaatcacactcgccacagtaatcatcagaatgtttgttagattaaaagtaagacctagaaattctatagttctgtaaccatgattcaaagggttttcacctctcttccattgatgaacgtttaagctggataaaggaatctatcataatgacagggtatattgtcattaatccaataactgtacttgccatatgaaagtattcgggatttttataggcaacagccacagcaagaatcgcattgcaccaccgcgctgcgctcccgagagatcgtatggactttcctttctcaacagctctgtcaaaagcattcattcttctgacgagcagtaaaaaattaaacaaactgaaaacagttcccagaataaggcctaaaaaaacggttttatacgctgttaaaccataacccagtacatacactgccaaaatgaacaataaatatttgcgttgtctgctaaatgtaagcttgggatcgtccatcaattatctgtctcctgatgaaaaaataatgtatagcttggatacggcaaaaatcagcggttaacccttagtagaagaccttttttgaccggcaaaacgggcctgttcgaaaaaatcattcatccgcaagccttgcagggatgctgtttcattcgcttaaataaatcctcataatacgggtttgctgagaggatttacattgaggatgaggactataatgaaagctatgaaaaccttctcataataccctcgtttagcatacaatagcccctaacatgtgtcaatctgtttaaagttaaaaaactttttatactttacgtctccacagaatgttcacattttcacctataattgtatacagattcaccgaatagcaaaaaactggataaaaaaatgaaacccccttttggggatttcattttttattttgttccaaacatgcggtcacccgcatctccgagacctggaacaatatatcctttttcatttaatttttcatctagcgccgcaatgtaaatatcaacgtccgaatgatgcttctgcaattcttccacaccctccggcgctgctacaagacacatgaaacggatatttttcgcaccgcgttttttaaggctgtgaatggcttcaactgcggaaccgcctgtagcgagcatcgggtcaaccacgatgaattcacgctcttccacatcagaaggaagcttgacatagtattccacgggttttaaggtttctggatcacggtaaaggccgacatgtcccacttttgccgcaggaatcagctttaaaatgccgtcaaccattcccaatcctgctctgaggataggaaccactccgagttttttccctgagatgactttcgatttcgcagcctgaaccggtgtattgatatccacttcttccagaggaagatcgcgggtaatttcaaatgccatgagtgtagccacttcatctactaactctctaaaatccttcgtacctgtattttcattccgtatatatgtcagcttgtgctgaattaaaggatgatcaaatacataaacctttcccatactgtgtttcagctccttttttattgtcccatcaacaattacacacttctattgattctacaaaaaaagacattgagtttcaagaacatcgtcaaaaaacccgccgggcataagccccagcgggttttaggatcttaataatctaattctttatataaaggaaatttatcagtcagagcagctacacgctgtcttgcttcttcaagttttccttcgtcttcgtggtttttcaatgcaagcgcaatgatagcaccgacttcttctaatgcgtctccgtcaaaaccgcggctagttacagcagctgtcccaagacggatgccgcttgttacgaaaggtttttcaggatcatatggaatcgcgtttttgttagacgtaataccgatttcatcaagtacatgctccgcaaccttaccagtcagtccgagcgaacgaagatcaacaaggataaggtggttgtctgttccgcctgaaacgagctggatgccctctttcgttaaggcttcagccagacgtttcgcgtttgaaatgacgttttgtgcatatgttttgaaatcgtcctgcaatacttcaccgaatgaaacagcttttgcggcaataacgtgcatcagcgggccgccttgaattccagggaagatcgatttatcaattttcttgccaaactcttcacggcaaaggatcataccgcctcgaggaccgcgaagtgttttatgtgttgttgttgtaacgaaatcagcgtaaggaaccgggtttggatgaaggcctgccgcaacaagtcctgcgatatgtgccatatccaccatgaagtaagcgccgacttcatcagcaatttcacggaatttcttaaagtcgattgtacgaggatacgcacttgctcctgctacgataagcttcggtttatgagcgagggctttttcacgcacgtcatcgtaatcaatatattgagtttctttatctacgccgtactcaacaaagttatattgaacaccgctgaagttgactgggcttccgtgtgttaaatggccgccgtgggagaggttcatcccaagtacagtatcgccttgctccaaaatcgtgaagtacactgccatgtttgcttgtgcgcctgaatgaggctgaacgtttacatgctccgctccaaagatttccttcgcgcggtcacgggcgatatcttcaacgacatcgacgtgctcgcatccgccgtagtagcgtttgcccggatatccttctgcgtacttatttgtcaaaacagatccttgtgcttccataaccgcttcacttacaaagttctcagaagcaatcaattcgatcttagtctgttggcgttcacgctcatttttaatggcgttaaacacttgttcgtcttgcgcaggtaaatgtttcatcagcgagatcctctcctatccgtatcctgttctttgtttttaccatcactattgtacatggtttttaaggccgatgtaaaagattatttttaaaaaatctaaatttttattggtaaaaacgaatattaataacttaaatttaatttaaagttcggaatttatttcactgtcttaaaataaaagaaaagactggctatgcagtcctttcattcgcactcataaaccgcccgcactccgccgattagtttcggccgtgtacgcgccaatgtcacatgagctgaaccgaggctgttttgagagacacgcacagggacagccaccggcttcagatgcatgccgataaacgtatcgcctatatcaattccggcgtcagcctgaatggtttcaacaagaacaggagacttcatctgcttaaacgcataagacgccatcgctccgcccgcttttggaacgggcacggcagaaacggttggaagcctgaacagcttggctgtttctgcttcgacgacaagcgctctgttcaaatgctcgcagcattggaacgccagatggattcccgttttttcccgaagctcggcaagtccgctgtagatgctttcagcgatatctacactgcccgatgtgccgatccggctgccggccacttcgctcgtgctgcatccaaggacgaagagctgatcttgtttcaattccgcttggtcctgaaactcagacagcatcgtcttccacgtttgtttcaactcattcattaaacagcacccctacaggtttttctcttcataatctgagatttttccaatacgcgtttggtgtcttcccccggtaaactcagtagtcagccagatttttgcgatttcccgagccaaaccaggtccgatcacccgttcacccatcgcaaggatgtttgtgtcattatgctccctcgtcgccttcgcgctgaaggtatcgtgcgcaagcgcacagcgaatcccttttactttattagcggaaatgctcatgccgatgcctgtcccgcaaattaaaatgcctctgtcaacttcgccgctaaccactttttcggccaccggaaaagcataatccggataatcgacagagccgctgccgcagtcacagcccatatcaatatattcaatttgcaattcgtccattaactctttgatttcatttcgaatgtgaacgccgccatgatccgatgcaatggctactttcatctgcttttcctcccagcgtgtgtgatgcggcccgcccgctttattgaccgcgcagcctgtccgctctttgattcacaccatatgatgtgcttttcactatattctactccttcacgcaggatttgcaaatgacctgtttgcagattttctgacaacttatctacggtcttttttcagctgttttgccagctgccgaagaagctcttcaagctcatctcgcgtttgtttatagatgtcaattgagccgccgaacggatcgatgacatcaccatggctgcctgtgacatattcttttaacgtaaacactttatcacgataacgtccaaattggctggcaatgatctgtttgtgctgatgggtcatagccagaaccaaatcagccgactccatatgttcttcagttaatggagaagacacatgattaagggcaatgtgtttttcaaacagcgcttcgactgcatgaggcgtcgctttcccattaggtgaagcaaacacgcctgccgagcggacattgacattcagcccttccatttctgcaattgatttaaaaagcgcctcagccattgggctgcggcacgtatttccagtacagacaaaaataatatccatgtcagtcaccccttatttttctctattatatatgaagaaaaaagaaacggcgacttcgtttcttttattggtatattaaattggcaaaagcagctttaatccaaacacgattaatatgatgcccccgagcgcttcgctgtatgtgccaagccatgactgcacttgttttccgaccagcaggcccagccatgtcaacatcatgctgaacagcccgaacagggtaattgtgaggagcggatgcgagccgtatatccccaagctcaagccgacggaaaagctgtcaaggctgacgccgatggcaaacagcaataagcccggccctgccggtgacatgaatcgttcttctgactgtttaaaagaggccataagcatttgaaccccaagaacaaaaagcagcgccccaccgatataaaccgctaacacgccgaggagccctgacagcatgttaccggccgccatccctgcgagaggcatgatgacgtgaaagaggccgatgatgaaaccaatatagaatatctgcttctttctaagtttgaccatgcccattccaaggccgacagaaaaagcatccatccctaaagcaaacgccatgatgcttaatgtaatcagttcgcctataaacaaatccgacatacataaataacccccttggacacgccccgcttttttagcctatgcgtgtccaaaaagggttagaacatctgactgctttcagcgaatcactcttcctccggcggctttcatcagcctgttcataatagcgagaccgacacctgtgtccggaaaggattccgcaataataaagtccaccttattctcatcaaagctgcgcaaagcatcatacagccctgccgcaacagtctcaagctgagcccgtcttccgcagctcttcacataatcagcggaataaacgcccgcgttttcttctgtcgtcaggacaccgacccgtcttccgccctgttgatattcttgaatgagatgctgaatgcgctctgggctgccttcgcaaatggcaagcggcgctgtcggcgcataatgtgtatatttcatccctggagaaatcggcttctcgttttggtcgctgagccctttatccacatgaatcggcccgatcaccgcttcaatttgttccttcgtaatgccgcccggacgcaggagaacagggatgtcgtccgcacatgaaagcacggttgattcgaccccgattccggtagggcctccatccataataccggctatgcggccatccaagtcgtgtgccacatgctctgcttttgtgggacttggcttgcctgatagattggcgctcggtgctgcaatcggcagtcccgattcgcgaatcaatgcaagggcaagcggatgatccggcattctaatggcaaccgtttcaagacctgccgttacacgaggtgaaagcgcatcaggtttgcaaggcagaatgagcgtaagtgctcccggccaaaaccgtttcatcaatgttttcgccttttccggcgctgggcccgttaaatcctcaagctggctgatatccgcaatgtggacaatcaggggattatcgctcggccgccctttcgcctcatatatttttttgacggcatccgtattttttgcgtttgcgcctaggccatatactgtttctgtcggaaaggcaacgacctcattttctcggagcaaagcggctgcttgtgcaatttgtggatcatttgtggataactcgtcagttacatccacaaaccatcttttcgttttcatttctgaccaaactccttattcacaacaataaaacgattgttttacgcgtgtaatccttttgaaagtataaaagatgtcctgtaataaaacaagcgttatccacaaattgtggacaacgctaataaagaagtggataagtatgtgtataaactgcacttatccagacgcttttttcatcaaaacggctccttctgtttgccgcgattcacagaagtgatcagaagaaaacagctcctccggtacactctcagctctttcaaaacccatggccgtcagaaaatccgcagaggaatgctgatttgctactaggtacacggttttgatctgatgcttttcgcacagcacctccatgctttgaaaaagcgtgacgatatggccttggtgaagcttgtccgatatgacaagtgatcgcagcagcccctggtcacagcttattttttcaataccgaggcatccggcaatgtttttctcactgtcctccagcataagaaattgagtgaagccttctttcacgccttcatagctggttttcgcctgttttaaaaatgcctcgagcacatctccgtctttttcccttgccacccgcagttgataaaacatccgttcaccccgtttttgcgttctttcttccaatctatgaggcaaatctatttttagaccagatgattaggaaaaaaggtcggaaatccattcgactaaaaagaatttcacttctgtgccgtcttctttttcttcgttctcttcttttttggctttttccgctttagcggttacgtcctcaagcactttttcagtctgcttttttgaggcttctttatcttcttgttctttgacggcttccccgttagaaaaatcaagaaagcagaggggcgggaacagcacacaccaccagttggcgccgtctccgtttccaagcgtaatcaaaatcgcttcatactcaccagcgggatataccatgttgccgtaaagctttgtcggaaacgagattttgtcaaaatcaacggatatcgactgattcgctccttctttctccattgtttcctttgcaattgctttgatttcaggcagctttgaacgaatcacgcgacgcgcttcttcaatagaagtaatatcctttacccaagttgtgatttctttattcaccgcgtctcttatatgacgttttaattgctggtcttgatcactatcgctgtttgccagtattctcaaacgaatcgcctgatcaggtatgaccaccggctgattttccgatttttgtgccgtctcttcttttgccagccctacgagcgctccggataataaaagaaagatatatatacaaatgattactgtttttttcatcggtccccaccgttcctctccgtgctttgtttctagccctattatggacaaggagagcctgggataaacgtgcagggtgaaaaaaatctagcaagctgttaatcttatttatggtacgatagtgttttaggaggtttaagatgaaatacaattatacagtgctgttatcagcattcacgatgtccgttctttattcagtaatttatattcattcatttatcattgccgctctcatcacaatggcattttattttctgtttccttatttgatcttcgcactgccgcttcaaatcatgatgaataaaaagccgaaacgtttcagccctttgtatctgctgtattaccttgccgctgcttttattgccaacgcgatcattttcggcgtgcttcagccttcgggacaatctctgtttcaaaatacagccttttatcttttcgctgtattaacagctcttatctattggatatgggattctgttttactgcaaaaaaaggaagcctaagaggcttccttttttattaaaacaaaatcgtcagtaaataacatagaatggaaggtatcgccgcaacaaagaaagcggccgccattttcatgcgagatgtacggccttctttggtttctgaatggtagtttgcccgctgatcgcttccgcttacagccaaacccgatgtaatgatcgcgagccccactaaaacgagagacgcaacgccaaaaatcgcttcatatgaaagagcctgcggaaaaatggtgccaatcatgctctcaatcgcaatgagcaggattcctgctgtcagggcctttttcatgtttacatcccctttgctggtgttaaacagcttgatccattcactcgccagcaagctgcttatttatttttatgaatcagagcgcatatggttctgtcttttccattaatatctttcagcacttccacttccgcccccttaaacgccttgaggatcaggtctttgaccgccgctccctgtttccagccgatttcaaaaacgacaaatactttatccttcataacaagcggaatgtcttccataaaccgcttataaaatttcagcccgtctccgccatcggtgagtgcgtgcagcggctcatgaaaacggacaatttccgataaatcagccatttcttcctctgaaatatatggcgggtttgagacaatgatatccgctttttttcccgccttaataaaaggctcaagcagatcgccctgataaaagcgcacattcgctccgagtttttctgcattggcagaggcgacttgcagcgcctctttcgaaatatcgaccgccgacacagaaaagctttggttttcaagcgcaagcgtgacggctattgcaccgctccctgtaccaacgtcaacaacttcgagcttgccgtcttcagaaaaaacactccgatatttttcaagcaaatgaaagacaacttcttcagtttccggccgcgggatcagcacatcatcattcaccataaattcccgtccataaaaaaactcttttcctataatgtattgaaccggcacgccctctttatgcatctcaacgtgacgcttaaagcgatacagttcgtcttcaccaatcggttcctgtaagcttgcgagcagcttgcttctctccattccggtatcataaagcaataggagctcggccgcattttcttctcttcccgcttcggttaaataagaagaagcccatttcagggcttcgaatatcgtcttcatcttaaccttccgactgctgaagcttgcttgcctgatcttcaacaatcagcgcttcaaccacttcgtcaagttttccttcaagaatctgatcaagcttttgaatcgtcaaaccgattctgtgatccgtcacacggttttgcgggaagttgtatgtgcggatacgttcagagcggtcaccagatccgactgctgatttccgtgtttgatcatattcagcctgggcttcctgctgaaatttatcatagattctggcacggagaaccttcattgctttttctttgttcttaatttgagatttttcgtcctggcatgatacaacaacacctgtcggcaagtgagtcagacgaaccgcagacattgttgtgttaacgctttgtccgcccggtccgcttgaagcaaacgtatcgacacggatatccttctcatgaatgtcaacctctacctcttctgcctcaggaagacatgctactgttgcagtggatgtatggatacggccgcctgattctgtttccggaacacgctgcacgcggtgggcgccgttttcatatttgagtttagaatacgcgccgcttcccgtaatcataaagatgatctctttgtagccgcccgttccggttacattcgcttccatgacctctgttttccagccctgaagctcagcataacgggaatacattctgtacagattgcccgcgaataaagcggcttcctcgcctcccgcggctccgcggatctccataataacgtttttatcatcattaggatctttcgggatcaagagcactttcagccgttctgacagtgtttccgtttccttctgaagttcagaaatctcttccttcaccatatcgcgcatctcagcgtccaacttctcttcaagcatcgcttttgcatcagccagctgttctgacgcatctctgtattgtctatatacgtcaactgtttcttgtatatcagattgctcttttgaatattctcttagctttttcggatcgttgactacttctggatcgctcaaaagctcatttaatttttcgtatcgttcttcaattgattttaaacggtctaacacggtcttcacctctgttttcctgtgcgtaacattctcattatagtatagtgattaaccccagtcaaaagcatttcaatcccagctggaaaagccccctctgctatactggaattcgaggagggatgatgttgctgaaatcaatacatcatattgcaatcatatgttcagattacgaaaagtcgaaagctttctacgtacataagcttggttttcaggtgattcaagaaacgtaccgcgaagagcgcggctcctataagcttgatttgtcgcttaacggctcgtatgtcattgagctgttctcgtttcccgatccgcccgaacgacaaacccggcctgaagccgcaggcctgcgtcacctcgcctttacagtcgtcagcttggataaggcggttcaggagcttcatgaaaaaggaatcgaaacagagccaatcagaacagatccgctgaccggcaagcgtttcaccttcttttttgatcctgaccagcttccattagaactgtatgaacaataacagtttttgaagaaaaaaaggagatacccactttctttgccgaatcttttcttgttttgtctaacgggaagggaaccgcattctatggtcgaatacctagcttaaaaggaggtatgggatcatgaatacaaatatggtagcaagtgaactcggcgtctccgcaaaaacggtgcagcggtgggtgaagcagctgaatcttccggccgaacgcaatgagctcggacactattcgttcacggcagaagacgtgaaagttctaaaatccgttcaaaaacaaatctctgaaggcacggcgattcaggatattcatctgccgaaaagcgctaaaaagcgcacaggcttccttgtccaaaaaacaagtagcgacacagaacgaagaatcgagcagcttgaacaaaagctggacacccttttacagcaaaggcaggacgaaagcgaattgatggcaaggatgtcggaactggaacgccagctgaaacaaaaagccgatgaaggtgtatcttaccagctgcttcagcaccgcagagaaatcgatgatattcttgcagatctgcaatcactgacctcacaaatgaaagaattcaccgctcagccgatccccgagactgctgctgcttctgaaaaaaccaaaacaagaaaaaaaccgctgctgtcactgttcaaatttcaaacctaaagcaaaaagctcccgtaaagggagctttttttgttacgcagtaagcgcgataatgattggaagtgaaatcaatgacagaatcgcactgaccacaaacgcagttgcagtttcttcttcttgtttctcgaaacgagtcgcaatcatggctgcaacggcagaaccagggaatgcaacaagaaggattgcttttgttgtttggtcagctggaagtccgatagcaagagcaatcaggaacattaacgcaggctgaaccgcaacttttagtaacgcaataccgatagccggcatactgagtttaattttacgaataccaacggtaacaccgacagcaaagagagcaacaccagatgttgtgcttccaagctgatcaagcattttaacacccagctcaggaagagtgaaattgaaaaccagcactaaaatcatactgattaacggagcagctgcaagcggctcacaaagaccatgcaggattgattttcctgtcatcttccagaagctgtcgccactctcttcgtttttcttagaagactcaccaacagtagcgataatgatcgcgagaggatcaaggatcgcgttaaccacgatacctgtgaccgcgatcggaatcgcaacttcattcgctccgaataagcttcccaataccgggatacccataaatgcgaatgtcggctgtgcagagttcaaagaaaatacagatgagttcgttaaatcatacttgaaaataaatctgcaaaccaaaagaatgatgatatagaaaccaacaatcccaataattaaagaaatcattaaaggtacttgtgataaaaattcacttctggaagttgtcaaaataccagcgataaagtgagctggaagtgcgtatttcgttactaacgtacttaccccttttgccgacttggcatcataacttccaaaatgtcctgcaaaccaacccagcacgataacaaagaagatcggcgccaggaggattaagatatctaagatgctcaaaatattctcctccaaatcctatgtccgtatactttagctttacaaaaagctttccctcggacagaaaaatttactcgctaattatttcgcgatgacttttttgtattcaggtgtccacattgcatcaagtaccgcttgtttcacatcttcaggctgacgatttgccacgccgtctttaattgctgcttcagcaacggcaatcgcaacttggatagaaacctcttgaagcttatcaatgcttggaagcaatcctgctccaggtgtttcaagatcaaccatttcagcaatcgcatcagcagttgcagcaaacatagcaggtgtaatgatacgcgcttcagctacaattgaaccaagtccaagaccagggaacgcgaatgcgttgttagattgtccgatttcataagaaacaccgttgtattctacattgtcaaatgggcttcctgttgcaataagcacttttccgtcagtccatttgaacagatcttcaggaacagcttcagcaaggtgagtcgggttagacatcggcatgataaccggacggtctacgtgagatgccatttcttttacaatttcctctgtgaatgcacctgaaacccctgaagtaccaatcaagattgttggtttcgcttgacgaaccacttcatcgaatggaatttgacctttttcatcgcgcttccagtctttcacttcatccgcattgcgaaggtaaggtttttggaaatcaaggatgccttcgatgtcttcagtcagcaagcctctgtaatcaagtgtgtagaaacgtttgttagcttcttcttcagataatccggctagcaccattgtgtcacggatttggtcagcaataccgataccagcagaaccagcaccgaagataacaacacgctgatctttaatagaagcgccggttttcttcatagcagcaagcacacctgcaagtgtaatcgcgccagtaccttgaatatcatcattaaatgtcaggatttcatgattgtattttttcatgatgttgcgtgcatttttgttgccaaggtcttcccagtgaagaagcgctttagggaagaatttcaatgcagcttttacataagcgtcaatgaaagcttcgtagcgttcaccttgaacacgttcatgcttgttaccaatatataaaggatcgtttagaagtttttcgttgttcgtaccgacatcaagcacaaccgggataacacggctagggtcaataccagctgcagcagtgtaaacagccaatttaccgattgcgatattaataccgcctacaccccagtcaccgataccgagaatgctttcggagtcagtagcaacgataagatcaatatcgcctgctgtcgcatgaaggttttcaaacgctttttcaataccgtcaatgttatcgattgacaagtagattccttgaggtcttctatattcatggctgtattcctgaatcgcttcaccaactgttggcgtgtacacaacaggaagcatttcgcgaagatggtttttcagcaatttatagaaaagaacttcgttacggtttgcaagatcacttaagtaaacattttgacgaaggcggtcaggctgcgcttggaattgctcgtacgcgcgttgtgcttgttgatcaagagaaagtacagttggcggcagaagtccttctaagccgagttcttgtctttcttctagtgaaaaagcaacgcctttatttaaagtaggaatagataaaacttcttttcctctaagagttgtttctaagtggccttctttcgttttttttatgttattcaagcaaatctccttctttcttgaaatagttaaccaagttaagtaataacccatctaaaatatgaccgatcatgatctttatgcgactttgtgacaattattcgaacaatgtctcaaaactatttacattacgtaagctattgtatgcctgtcaaaatcaaaattcaagggaagaaaattacttaattttttaatatacttatttaaattttttaattgagtattatcagaatataaaaaaaacaccggtgtttttagccggtgcattctatctttatacccatgttttggactattttttagatttacctgggacttcgtgatgatgtctgcatcttgcttcatatgattcagatgcaccaaccaaaatgaccggatcatcgtaagaagcaggtttgccgtcaatgaggcgctgtgttctgctcgccggtgatccgcaaacagaacagacggcttgcagctttgtcacactttccgcaatcgccatgatattcgggacgacaccgaacggctctcccctaaaatccatatcaaggcctgctgctatcacacggtagcctttatcggcaagagatgataaaacctcaacaatttcctgatcaaaaaactgcacttcatcaaccgcaaccacatctgtactttcacagatgtgatcccaaatgtccgcagcagacgaaatggcatagctcgtcatcgatgttccattatgggagacaacagcagcttcgctgtatcggttatcaattacaggcttaaataccctgacttcctgcttggcataagttgctctcttcactcttctgatcagctcttcagatttccccgagaacatgctgccgcaaatcagctcaagccacccgctttgtttcattatgtacataggcttcgctcccctctctctgccagctgtgttttagacaatataaaaaacaggcaagactgctgcttgcctgttgagaaatctattattacttaagaccgtattttttgttaaagcgatcaacacgaccatcagcagaagcgaatttttgacggccagtgtagaatgggtggcattcagagcaaatctcaacgcgtacctcttcttttactgagcctgtttcaaattcatttccgcaagcgcatttaactgttgcttttttgaaattaggatgaattcctgctttcattgtatccatctccttccgccctgaatcccgtgtggaaacagagttattatttcggatcattgtccgaaacgcatatgagaaaattatatcagtgatttacttcttttgcaaatacaatttaccttcttgcagatgatagatttgcctgtttccattcttgattgagaatatcgaaaaattcctggtttgttttggtttttttcatttttctcatgaacttttctgcgaaatcaggtgaatcagacatcgttttgcggatagaccataaacgatcaagatgctctttaggcacaagcagctcttctttgcgcgttcctgaacggcggatatcgatggcagggaagatgcggcgctcggcaagagagcggtcaagatggagctccatgttgcctgttcccttgaattcttcataaatgacatcatccatacgtgaacctgtatcgaccagagccgtagcaaggatggttaagctgccgccctcttcgatatttctcgcagccccgaagaagcgtttcggacggtggaacgccgctggatcaatccccccggaaagcgttcttccgcttggcggaatcactaagttgtaggcgcgggcaagccgtgtgatgctgtccatcaggataatgacgtcttttttgtgttccacgagacgcatcgcacgttcaagcacaagctcggccactttgatatggttttccggcacttcatcaaacgttgagctgacgacatccccagctacagagcgctcgatatcggttacttcctcaggtctttcgtcaattaaaagcacgatcagctctgcttcaggctggttcgctgtaatgctgttggcaatttccttcagcagcatcgtttttccggctttcggcggcgcaacaatcaatccgcgctgcccaaatccaaccggcgccatcatgtccataattcttgtagacaagaagttcggctttgtttcaagcaccatttgacgatccgggtaaagtggcgtaagagccgggaaatgcacacgctcttttgcagattcgggatcatccccatttactgcttcaacgtgcaaaagtccatagtaacgctcattttcttttggcgggcgaaccttgccagatactttgtctccgttccgcaaatcgaaacggcggatttgtgaagctgagatgtaaatgtcttctgagcttggagagtagttgatcggtctcaggaatccgaaaccttcagactggatgatctcgagaacgccttccataaacagcagatcttcctgttctgcattcgctttcagaatggcgaaaatgagttctttttttgtcagtttgctgtaataggagattttataatgtcttgcaagttcataaagctctttcaatttcatattttccaaagaggaaatagatacgtctttcataaaaacaccacgcttttcatagtcaatatcttactctgaacatgtcatctgctgcttttgcacaacatccgccaaagcacattctttttttaacataaaggaacttctatcggtaacacttccacccatgatcggcgcttttgttaaaaggattgtcttaatgagttttgaaggaagcgaggacaaaaacatgagaagatcaatacttatatcgtctgtatgcggtagaaattgaaactttcctagtgcttaaaagaaggtattacgcagtaaaattcgcagcactctttatttttaccttatttcaaaaaattattcaactgaaataaggttttgacacggaattgatagagttgacgcttttctgcaaaagttaaagcgggctcacacccgctttttctgtttgttatggacggattacaagatttggtttctttttcaagctgtgtctgccgtcaacgaaacgaacagtgcccgattttgcacggataactaagctttcagttgtaccgacagagcctttgaattgaactccttttaacagctcgccgtcagtaacccctgtagctgcaaaaatcgcgtcatcacccttcacaaggtcttccatgcgaaggactttgcttaaatcaaggcccattttgtgacagcgagtgatttcttcttcgctttgcggaagaagtttaccaatgatttctccgccgagtgcttttagcgcaacagcggaaagcacaccctcaggagcgccgcctgatccgaacaggatatcaacgcccgtgtggtcgaaagccgtgttgatggcgcctgcgacatcgccgtcattgatcaatttgattctggcgccggcctcacgaagctcggaaatgatttttgcgtgtctttcacggtttaaaattgtggcaacgacgtcctcaacgtccttgtttttcgcttttgccaccgctttaaggttgtcaatgacaggtgcttcgatgtcaatgcagcccaccgcttccggaccgactgcgattttttgcatatacatgtcaggagcattcagaagcgtgccatggtctgcgaccgcgataaccgtcagcgcgttccagccgccgcttgctaagatgtttgtgccttcaagagggtcaactgcgacatccacgcgcgggccgtacccgtttccgagtttttccccgatatacagcattggcgcttcgtccatttccccttcaccgattacaacagtccctttcatcggcactgtatcaaaaacgtctctcattgcacttgttgccgcttcatcagcctcatctttttttccccggcccatccatcttgctgatgccaatgccgcagcttcggtcacacgtaccaattccattgataaacttctttccatttcaacacgatctcctctcacaagaaaccattatgaattttgaagctgttctatttcttcgtcagtcattctttcacgccaaattgtcgctccaagcccttcaagcttcttctcaaggctgctgtatccgcggtcaatatgctccagtcccgtaatttccgtgacgccatcagccatcagtccggctaccaccaagcaggctccggcacgcagatcactcgccttcacttttgcgccttgaagctcgacaggacctgtgatgatggcagatctgccttctactttcatattggcacccattcgtctcagctcatcaatgtgcttgaatcttgccgagtagatggtgtctgtgacgacactcgtccctttcgcccttgtcagtagcgccgtcatcggctgctgtaaatcagtcggaaaccccgggtatacgagggttttaacgtcaaccggctttaagttcttctgcccgccgacaatgaggagctggtcgtcgcttgtttcgatatgatagcccatttctctcaactttgccgttaacgactctagatgagtgggaatgacgttatcgataatgacttccttgcccattgcagcccctgcaatcataaatgtcccggcttcaattctgtccggaatgatcgtatgcttgcagccgtgcagttccttcacgccgtcgattcgaatcacattggtgcccgcacctttgattttggcgcccatgctggtaagcaatgtcgcgacgtcaatgatctcaggctccttggcagcgttttcgatgatcgttttcccttctgccaaaacagcggcgagcataatgttaatcgttgccccaacgcttacgacatctaaataaatccgtgcgcctctcagcctttcagctcgcaaataaatggcgccttgttcattggttacttcagctccgagtgcttcaaagcctttgatatgctgatcaatcggacggggccctaagtgacagccgccaggcaatccaatgaccgcctgcttgaagcggccgagcatcgcccccattaaataatatgacgcgcgaagcttttttactttcccgttaggaagcggcatgctgatcatcgacgtagggtcaacaaccatttccccattctcaaaatgcacgttgccgccgatttcctttaacaggtcacgcagcgtttcaatatctgaaatctctggaagcccttcaattgtcacctcggaatttgccaaaatggttgcaggtattaacgcaacagcgctgtttttagcgccgctgatatgtactgtaccgtttaacgagtcaccgccggcaatattcaacttttccatgatagtctccttccataagaagatagctgcggagctaaataaaatgtcattttattctgtctctgcaaataaagctcatgtccaaaatctagccaattcgaagagaaagaatacaacacattgtaaaatatcaggaagaaaatagcgaagctttggggggtacaggtttcaaaagatgcacagagacccgccggctcgagagacatcgtcgtcatccggcaaaagcagtacgcatacccttcattccgatatcagcttctgcagcccaatgattccttctctgtaaagcggcgtcagcatctgaagatccgctgtatcaggtcggtgaaatacaaaggccgcggcaaacaggcataaagctgtttgccgcccctttcattatttgttccagtctgccaggaattgttcgattcctttgtctgttaacgggtgtttagtgagcgcatgaatgactttcagcggcattgtgccgatatgagcccctctaagagcagcttctgtcacgtgctgcggatggcggattgacgctgcaatgatttgcgtgtcaaggccgtgaatatcaaaaatctgtttaacttctgaaatcaggtcaagcccgttgtggccgatgtcatctaaacgtcccaggaatggagatacatatgttgcccccgctctggcagcaagaagcgcctggttggcattgaagatcaatgtaacgtttgttttgatgcctaagtcagtaagtgctcttaccgcttttaaaccgtcagacgtcattgggattttcaccgtaatgttcggagcgatcttcgccagttcttttccttcctcgatcatttcctcagctttcaaagaaataacctctgcgcttacagaccctttcacgacgtctgtgatctcgcgaagacggtcgtggaatgatacgttagcttcctttgctactaaactaggattcgtcgttacaccggcgagaattcctaattcattcgcttctctaatttcatcgatattggctgtatcaacaaagaataacattttcaaaaagcctccctgattaagaaattttctgaactgcgaatatgattgcgctttctaaagatagacggaaaaccgcctgtcaagctgtcaggcggctataaaaagttccaattgaattaagcttggtttgaagaaccaaattcacgcattttaccgataactgtttctttgatcgcttcacgagctggtccaaggtatttacgtggatcgtactcgtcaggcttagctgccaatgtttcgcgaacagcttttgcagaagaaatttggttttcagtattcacgttgattttagctgtaccaagtgaaattgattttttgatgtcagcagtcggaattccagtaccgccgtgaagaactagcggaagaccagttgattttccgatctcttccatttctttgaagccaaggtttggctcacctttgtaagggccgtgaacagaacctaatgcaggtgcaaggcagtcgatgccagtgcgctcaacaagctcttggcactctttaggatcagcgtagattacgccttcagcgataacgtcatcttcttgtccgcctactgttccaagctcagcttctacagatactccgtggaaatgagcaagctcaacaactttagcagttgttgctacgttttcttcaaatggatggtgagaagcgtcgatcattacagatgtgaaacctgcatgaatcgctttcgcacaagattcaaagcttgaaccatggtctaagtgaatcgcaacaggaactgtcactttgtactcttccataagtgcttttaccatagcaacgactgttttgaagccgcccatgtagcgtcccgcaccttcggaaacaccaaggatcactggagatttttcttcttcagctgcttgtaaaatcgcttgagtaaactcaaggttgtttaagttaaattgtcctacagcgtaccctttttctttagctgtattcaacatttccgtcatagaaactaaaggcatgtcgaatgtcctccttatgtagcctgattgtcttctagcgaaaaaagctttccaccctagcatgacccatatattgctgtcatatgtaaatactcagatcgctttttctccataactaggataccaacttttcgacaaatcggcaacataatgacatgattcatttgtttcttctttttgtcagttagacttcaggggcagatattttttgacggcgtctctgatttcgtcgatgtcaaacggcttggcaaagtgcgtcagagcgcccaattccttcgattcttggatcatgtcgagctctccgtatgccgtcatgataatgacccggatgttttcgtcaatgaccttcatccgttttaagatttcgattccgtccatgccgggaattttcatgtccaacagcacaaggtcgggccgttcttttgtcacaatgtcaagcgcctgcaggccgttcgcagcctgaaacgtctggtagccttctttattgaacacttcatttagcaaaatacgaatgccgtattgatcatcaacgattaaaattttttcattcatcattttacaccccaatattatgattttcgtcaaaagtaagcagtattgtatgtattctgtttgattttcctatttcctttaattataatagtctactttacgacattttctgagcattttctcttttgttgtatactgatattgtacgttataaaggaggattcacttatgttgaaaatattcacgacgcagttaacaggtattttttcccgcattcaggataaggaatctgacgcgattgaagatggggcgcggctgcttgctcaagcggtgatcagcgggcattccatttatttatacggagcgaatgagcttcagggcgtcttttatgaggccaccgaaagcaaagaacccttcccatctgtcaaagcctttccagaaagcgctgaggaagtgacagaaagcgacagggtgctgatgttttgctcagggacgggcacagccgaagaacaggccctcgcaaaagagctttatgaaaaaggtgcgggagtcgtatgcgtatcgcccgcagccaaagacagtgctggaatagaacagtattgtgatgtgcatattgattctaaattaaaaatgccgcttgttcctgatgaagacggcacccgttacgggtttccctctttaatgactgcactgtatgtctatcacgctttatcgtttacactaaaagaaattctgcaagagtatgcataatatcttattgtacatgctggaacttgccggaaacaaataaaaaaagacttgcccgcttttgataaacggcaagtcttttttattacttctgatttgcagcttcgacagacgctccgataaagcctttgaatagaggctgaggtcttgtcggtcttgacttgaactctgggtggaactgagaagccacgaaccaagggtggtctttcagctcgatgatttcaacaaggcgtccatcagggcttgtgcctgagaatacgaagccttgctcttccatttgctgtctgaattcattgttaaactcataacggtggcggtggcgctcgtacaccacttcatcctgatacacttcaaaggctttcgtgccttcttcaagcttacaagggtaaaggccgagacgaagcgttcctccgagatcctcaacatccttctgttcaggaagaagatcaatgatcgggtattgagttgacggatcaatttccgctgagtgagcgccttttaagcccaatacgtttcgtgcgtattcaatagacgccacctgcatgcccaagcaaatacccaagaacggaatgttgttttcgcgcgcgtattttgtggcgacgattttgccttcaacaccgcggtctccgaatccgcccggcacaatgatgccgtctgttccgcttgtgagttctgcgatattgttttctgtcacttcttccgcgttgatccacttcacttttacatctgtgtcaaacgcatagcccgcatggcggagagactcgacaacagaaatgtatgcgtcaggaagctcaacgtatttgccgacaaggccgattgtaatcgtttgagacagattgctgactttgttaacaagctctttccactcggacatttccgcttctttgcatgccaatttcatgtgctcgcaaacaagcttatcaagcccttgtttttgaagctccagcggaatggagtaaaggttgtccgcatcttcacattcaataaccgcttttgtatcgatgtcgcagaaaagcgcgattttatctttcatatcttgagaaatcggcatttctgtacgaacgacgatgatgtttggctgaatgcccaagctgcgcaattcttttacgctgtgctgtgtcggttttgtttttaattcgccagcagctttaatgtaaggtacgagcgtacaatggatgtacattacgttttcacggccgatatcgctcttcatttggcggatcgcttcaaggaatggcagtgattcgatgtctccgacagtaccgccgatttctgtaatgacaacatctgcgtttgtctctttccccgcgcggtaaacacggtctttcaattcgtttgtgatgtgcggaatgacctgtacggttccgccaaggtaatctccgcggcgttcttttttaagaactgttgaatagattttacctgttgtcacgttgctgaatttattcaggttaatgtcgataaaacgctcatagtgaccaaggtccaaatctgtttcagcgccgtcatccgttacgaatacttcaccgtgctggtacgggctcattgttcccgggtcaacgttgatgtatggatcgaatttttgaatcgtcacgttcagtccgcggtttttcagcaaacgccctaatgaagctgctacaataccctttccaagtgaggatacaactcccccggttacaaaaatatatttcgtcatttcgtttgctcctctcttcgctcttagctacatttttaaaatgtactattttataaaaaatcatttagccttttaaatgatttataagaaaaatgaggggtgaaaataagaaagctccctttcaatttcttgaaagggagcataacgtactatgttctctcttcgtttttgaagagcccaaaatacatactacctagttcgactatgaaagtcaagatcgttttgaagatgaaatctgatactatttaatttcctcttcttcatcatcatagtcttcatcatcttcatcaacaatatcttcttcgatctcaagatcgtcgtcgtcttcgtcaagatcttcatcgtcaaaatcgtcggcttcaagatcgagttcttcctcaacttcatccaaatcaaggtcgtcttcgtcgatctcttcaaactcgtcaagatcaagatcttcttcgactgctttcttcgcttttttctttttcgccttgactgtcggctgagtttcttcatcaagctgatcatacggataccagctgcgaagcccccacgtctggtcagaaagcgccaggaagcggccgtcaatgtttaaatctgtataaaattgagcgatgcggtctccaagctcttcttttttcacgccgagcaaagatgcgatttcatttaaaagctcctgaaaaggaactggttttttatgttcttcaaataattcgtgagcgatttcaactaaagccatttcctttagctcttcctgtgaatattgtttgatacccaaggtcggacactccctttctattacttatatgtatctgttttatcaataatgaaagcgattttgtatcgttcttatacaaaccatacctctcattataaacaaaataaaacagaatatgctacccttaacagcgttaatttaaataattttacaagagtgatccgactgagagatgttttccgttaatccgcgagcattctggagatgaccagtctttgaatttcttgggtgccttcatagatttgcgtgatttttgcatcacgcatatagcgttctaccggataatcttttgtataaccgtagccgccgaaaatctgcacggcttcggtcgttaccttcatcgccgtatccccagccatcagtttggacatggcggaagcttttccatatggaaggcccgatgattctaaccatgcagcctgataggtcagtagccttgaagcttctatcattgtcgccatatccgcgagtttaaaagcgatgccctgctgctcggcgatcgattttccgaattgctttcgctcttttgcatattgaagcgccgcatcaagcgctccttgggcgatgcctacagcttgtgcagctatgccgtttctgcctccgtcaagcgtcttcatcgcgattttgaagccttctccttcttctccgagacgctttgatgcgggcactacacaatcttcgaacatgatttccgttgtcggtgaagaacggatgcccagcttcttttctttcttgcctgtaaaaaatccttcaaaatccttttctactataaaagcggtaatgccttttttctttttctcgggatcggtgacggcaaaaacaatgtaaatatcagcaacgccgccgtttgtgataaacactttggaaccatttaacacatagtcatcgccgattcgttcagcagttgttttcatgctgccggcgtcagatccagaccctgcttcggtcaatgcgaatgcgccgattttctctccgagggccagctgtgttaagtactctgtcttctgctcctccgtcccaaaggcaaacagcggccagctgcaaagagagatatgggcggaaagcgtcacaccggtggaggcgcacacttttgacagctcctccaccgcgatgacgtaggccaaatagtcacttccgattccgccgtaatcttcaggccatggaattcccgtcagccccagatttgccatttcccgaaacagctcgcgatcgaagcgttcttgttcgtcccgttctgccgctgtcggggccacctcatgcttcgcaaaatcgcgcaccaattttcgtatcatctcatgttcttctgataatgaaaaattcattgcttctcccccattttcagatcagcgcctaaaacggattgagccagaagctcgactatgtcatacgttttgacttggtcttcagcttccttcgcctttgtgccgtccccaagcattgtgagacagtacggacagccggaactgatcaccgatgggttgactgcgagcgcttgctctgtcctggcgacgttaatcctgttgcctgtttcttcctccatccacattaatcccccgccagctccgcaacacatgccggtttcccggtttctctccatttcaacaagctgcacgcccggaatggctttcaaaatctctctcggcggatcataaacttcattgtaccggcccaaatagcacgaatcatggaaggtaatcgtctcatgaagcgggtgctgcggtcttaattttccgtttttcacaagctcggccagcacttctgtatgatgataaacctcgccttcaaatccgaaatccggatattcgtttttaaataaattgtatgcatggggatcgatcgtaacgatttttttgacatcatttttttcaaattcagaaatattcttctcagccagctcttggaacaaaaattcatttccgaggcggcgcggcgtgtctcctgaatttttttctttattgccgaggatcgcgaaggacacgcccgcgtgattgagcagcttggcaaaggaaattgcgattttctggcttctgttgtcgtaagaccccatggagcctacccagaaaaggtactcaaattcttttccttcttttttcatttcttttacagtcggaatctcagcatccggcgcctcgtcacgccaattttcacgttccttgcggttgagtccccacggattcccctgccgctcaatacttgtcattgcgcgctgggcgtcactgtccatttttccttctgtcagtacgaggtagcggcggaggtcgatgattttatccacgtgctcattcatgaccgggcattgatcctcacagtttcggcaagtggtgcatgcccaaatttcttcctctgtgatgacgtcgccgatcaagcttggattgtaatcaagcgccgctgcggcttcctgcgatccgctgcccgctgacgccgcagccagctgattgcctctcgtatgccgaaacgctgctgcgggcacccatggggagcgcgaggtgacggcagcgcctttttccgtgagatggtctctgagacgcaaaatcaagtccatcggagaaagcatttttccggtgcctgttgcaggacacatattggtacagcggccgcactcgacacacgcgtatagatcaagcagctgagactgtctgaaatcctcaatttttcccgctccgtagctttctttcgtttcgtcggtaaaatcaattttttcaagttttccggcagattccattctgttgaaaaagacgtttgccgggccggcgattaaatgggcatgcttcgactgaggcacgtacactaaaaagctaagcaagaacagaagatggatccaccatgcgatatagaaaatcaccgccgcacctgttttcccgacaccgctaagcataaacgcaatacctgaggcaattggctcgctccaagaaagcccatgctcatgccaaatcagattcattccgttcccaagcagaacggtcagcattaatcctccgataaaaatgagaacgagtccggctttgaaaccgcgtttcagcctcacgagcttttcgatataacgtctgtagaatgcccacccaacagcaattaaaatgagaaacgtaacaatttcctgaaaaaaggtgaaggcgggatagaccgggccaagcggcagattccggccgggagccagtcctttgatgataaagtcaattgctccgaactgaaccaatataaatccgtagaaaaacatgacgtgaatgattccgcttttcttgtccttgagcagttttttctgtccgaatacattcacccatatggcgtgaagccgttccttgaaccgttgatcaaattgttctttctggccgagcttgatgtaggccagtctcgttttgaccaagtacacaaacaaatagacagcgtaagcggttacaatcagaaataataatgcatttgcgatgagaaagccgctcattccaattccccctttttactgataaagaccgcgatcccctacccccgaatctgtataagattatctttatgataaataatgaatgagtgttcagtcaataattaaattcctgctgttcgggcacactacctttactacggaaaggagtgccggtatgaaggtatttatcgtgattatgatcattgtcgttattttctttgccttgattctgcttgatatcttcatgggccgtgccggatacagaaaaaaggcgtacgagcctgttttttcaaaaaagaagagtgacatcgaattgatccactgcggcgctgatctcgttgagcggatgatgaatgatattcgccaggccgcctcttctgttcacatgatgttttttattatgaaaaatgatgaggtcagccacaatatgtataccttgctgaaaacaaaagcccaagctggcgtctccgtttatttacttctggattgggcgggctgccgggcaattaaaaaaacggcgctgcagacgatgaaaaatgccggcgtccatgtccatgtgatgaatcgtccccgttttccttttttcttttttcacatgcaaaaacggaatcaccggaagattacggtgatagacggaaaaatcggttatatcggcgggtttaatatcgccgaagaatatcttggaaagaaggcgaagttcggcaattgggaggattatcatctgcgcatgatcggagaaggcgtacatgatcttcaaacgctttttgcttctgatctaaaacgaaataccggaatcgaactgggttcggatgtttggccaaagcttcagcaagggactatttctcacaagatatatgcgaccgacggttattcccttgaaaacatatacttggccaacattgcccaagcgaagaatcgccttacggtttgcacgccttattacattccatcaaaaccgcttcaagaggcccttattaacgcaagaaaaaacggcgtatccgtgagaatcattgtaccgatgaaatcagaccatccgctggtacgagaagcggcttttacgtattattcggagctcttggatgccggctgtcttatttatcgttattatcaagggttttatcatgtaaaagccctcatcatagacgaccatctcagcattatcggaacagccaacttcgataaacggagcctgttcttaaatgaagaggtgaatgttgaaattgatgacgaagcgtttacaagtgaagtctatgccacaattgaggaggatatgaaaaagtcggagctgctgacgatggaggatttcagcaagcgcacattcaggcagcgcccggcggaatggctcggcagggcattatcttatttcttataaaggagagttcctatgattttcagattcgggttcgtttcaaatgcgatgagcctttgggatgcgtctcccgctaaaacattgacattcgcgcgttattcaaagctttcaaagactgaaagaaaagaagcgcttctgactgtgacaaaagccaatttgcgcaatacgatgagaacccttcactatatcatcggacacggcatccctttgtaccgtttttccagttcgattgtgccgctggctacgcatcccgacgtgatgtgggattttgtaacaccgtttcaaaaagagtttcgggagattggagagcttgttaaaacccatcaactgcgaacaagctttcatccaaatcaattcactctgtttacgagcccgaaggaatccgtcacaaaaaatgcggtaaccgatatggcgtatcactaccgcatgcttgaggccatgggcattgctgatcgctccgttatcaacattcatattggcggcgcttacggaaataaagacaccgccactgcacaatttcatcaaaatataaaacagctgccgcaggagatcaaagagcggatgacacttgaaaatgatgataaaacatatacaacggaagaaacgcttcaggtctgtgagcaggaggatgttccgtttgtctttgactttcatcatttttacgccaatccagacgatcacgccgacctgaatgtagcactgccccgcatgatcaaaacgtgggagcggatcggccttcagccaaaggttcacttgtcttccccaaaatcggagcaagcgatacgcagccacgccgattatgttgacgccaactttttgctgccactgttggaacgctttaggcaatggggaactaatattgatttcatgattgaagcaaagcagaaagacaaggcgcttctccgcttgatggatgaattaagctccatccgcggtgtcaaacgcatcgggggcggtgcgctgcaatggaagtcataaatgtgcaaaaataggtttacgacttgtcagctttgggaacttaggctatataagacaacaatcgatggaggagaaagatcatgaaaaatatcaagtctctgaaagtagccgcacaggcctttactttaagaaatttgattcatctttataaaatgtgccattccggaagccacgaggtttatatttattcaaagaaaacgatgtgcaaaatcaaaagcttaattgagcttgaaacgttccgcatggctcataatgaaaaggaatatctgatcgtagttgaaggaacaaaagcatcacagctcattgaaaaattccaaaatctcatcgagcctgctgagagagaagcgctctaacttacatacaaaaaaggatagacatctgtctatcctttttcttatgctcttacataatggagctgaaccgcttgtccaaattgttttgtcccttttaaccgcagttttgtttcatttgttagttcgtgaaacagcgggatgccgcttcctaaaacgacgggaataacagtgatgatgaattcatcgatggcatcttctttcataaaggcattcaccagctctgccccgccagctatccagatgtttgagcctttttcctgtttcaaacgggcagtgaaggctctggctccctcattgataaacgtcacatgttcatctcgataactgtcgggcgatcctgtaaaaacatagcaggttttatcctgatacgggaaaaccggtgttagcactttaacgtgctcatatgtgctccgccctaaaatgactgtatcaacagtctgataaaaatcactgtagccgttgtcaccttcaccttcaaattcatccagccaatcgatgcttccatcttcttttgcgatcatcccgtccaatgaaacagcaatgtacagcacagtttttctttccatgttctcctcctatcgatgcaccatttgcccgaattgcgcttgatgcagcctgctgtataggcctccggcttcgatcaggtcttgatgacggccttgttcttcaataccgttgtttgtgacgactacaattctgtccgcgtctttgattgttgccagcctgtgggcgatgacaagcgtcgtgcgcccctcagacaactcttgaagcgccttttggatcgccgcttccgtctctgtatcaagggctgaggtggcttcgtcgagaatcaagatcgatggatttttcaagaacatccttgcaattgacagacgctgtttttgcccgccggaaagcttcacgccgcgttcgccaatcatagtatccaatccatcgggcatgttatggacgagctcttccagatgcgcctgcttcacagcttgccaaatgtcttcttcagatgcgcctaatcggccgtaggcgatattttctctaagcgtgcccgagaataagaaaacatcctgctgcacgacgccaatctgcccgcgcaacgaagaaagcgtcatgtcttttatactgatgccgtcaatcgtaatgtcgccctccgatgcttcataaaaacgcggaagcagactgcaaagcgttgatttcccagcacctgacggaccgacgaacgccaccgtttcccccgcttgaatggataggttgatgtcattgaggacattgtgatggtcatcatagccaaacgaaacatgtttatagcggatattacccttcaggccggaaacatctctcgcatcaggtgaatcctgaatgtccggctctgtctccatgagctccatatagcttttgaaacccgcgatccccctcggatacatttcgataatggcattaattttgtcaataggcctgaacagcacattcgtcaggagcacaaacgccacaaattccccgtacgataaggagccgcgaatgacaaaccacgtcccgcacaaaagaacaaacagcgtgacaaaccgagtcagcatatagctgattgacccgtttttcgccatgattttgtaggaagaaagctttgtggaacggaaacgctggttgttgacggcgaagcgttctttttcaaatgcttcatttccgaacgcctgcacaagccggatgccgccgatgttattttctacacgcgcgctgaagtctccgatatccttgttcagcgtggtaaatgctttggtcatttttttgttgaaataaagcgctagccaaatgacgatcggcataatgataaacgttaataaagcaagctgccagttaataaacagcatcactccgaacgccccgagaatggtcatgaccgcaatgaataagtcttccggaccgtgatgggcgacttcaccgatatacattaaatcgttcgtgagcttcgacatcagcgttcccgtcttgttgttgtcgtaaaatttgaacgagagcttttgcaaatggtcaaaaagcgactttctcatatcagtctcaatattgataccaagcatgtgtccccagtaggtcacgatatactgaagagccgagctgagcgcgtacaccgcaaataacccgattgaggtcgcgatgatcagcccccagtccctgcccggcagcaaggtatcaataaaataattgacgatcaaaggaaaactcagctccattaaacctcccgcgatcgctgagaaaaagtcgagaaagaacaacgttttatatggtttataatatgaaaaaaattgccgcagcaccctatcttcccccaatgtataaataactgataatatttctcaattatactatacacgggctgttttgaaagatcagatttcttttttcttacagaacacctgaaaacaggcgggcaaatgactcttttgtccggtcagccacgcctcttttataaaagccgacagggctgagcttttcactttcctgcatatcttcttcaaaatgggcctcaagggttcggatcgcttcggcatccgtgaagaacacattcacttcaaagttgagctgaaagctgcgcatgtccatattcgcggtaccgacggaggcgagatcgccatcaatgatcatgactttttgatgcatgaagcctttttggtaggagtacacttcaatgccctcaaggagcagctccgggaaataggacctcgacgcgtattgggtcaaaaagctgtcgttcttctccggcaccataacccttacctctaccccctttgtcgccgctgcttttagcgccgtgcgaatggattcattggggacaaaatagggcgtggcgatccatattgatttctgcgctgaagaaatcatttcataataaaggtcgctcatgctttccttcatgtcagggcctgtcgcgacaatttgataaatgcctcctccttccacgggaaccggggtattgtactcctcttgatcaattagcacttcattggagacatattcccaatccagcataaagatagcgtggagcgtttgcacaatttccccctcaagccgcaggtgtgtatctctccaaaatccgatgtacggatctctgctgatatattccttcccaacatttaatccgcccacaaaaccggttttcccatcgatgatcacgattttccggtgatttctgaaattcagcttctggttgaaaaacccgtatttcagcggagaaaacgggacgatgtccacccccgcttgtttcattctcataatatctcttcttgccagcttcatgcttcctgccgcatcgtataaaaacctcacctcgacaccctggcgcgctttctccatcataatatccatcatgccgcgtccgagcatgtctgatttaaacatgtagtattcaatatgtatgtaagattccgcttttctcattgctttgaaaatgtccgggaaggtttcttcgccgtttttcagcactttgatgttgcttttcgtattgatattcatatgggcagccctgatggaataggtaaagaacctctcttgattgtccttcagccctgtcacttcgggcgtttcctccttgtcaaacagcttcctgagcttttccctgttgtacattcgttttgtcttaaacagctttccctttacataaagctgtcccgaaaacagataaaacacgtagccgacgattggaaaaaagacaagaatatggatccatagcagcgtgtgctgcgaggtgcggttttcaagaattaatgaatagatgctgaacaaaataatgcttatatagcaaagcaatcctccgtaaaactcaagcctggaaaccggaaaaaaccaaatgacatatgccccgatgagcatcatatataaaaagaaaaattccagtctccttttcagcatcctgattctctccaatctgattcaattacctctgtattacctcttttttctaatcgataaaccttgtaagtaaataacctctccgccgaaggaggagaggtttagaaaaaactaactgtcaagaaattcatccgcatcgtttctgcagaaataaagcaagactattggcaacgccgagtgaagcctgatgctacaacatgaacggcaggccgaacccgctcagcactccggcaagcgccgaaaaagaggcggcgctgtgactgcaaatacggtggatagagtgaatttgatgcccactctgatgagagaaaatatataaaacgggatattgatcagaaagatataaggagttagtcaggctgagtcataatctgctgttccgccggtttaaaatgagtaaaatccgttttattcttgatgttatttccaaatacaaacacaacaggattcccggccgcccagccattaccttggcagaagatatcttatgttttcatcaagataaaaaaatccccctctttcaagggggattttcacgagcgtttccgatatacaacgtagctgcgggtcagatacttgagcggcagactgaacacatgaaccaatctcgtaaacggccacaggataaaaacgacgtatcctatcacaatatgaaacttaaaccatagcgggacactctccatcaaagaggcgtcaggcctgaacaaaacgatttccctgaaccagggcccgactgttgtccggtaatcaaatcctttcgaatcaatgttgagaaacgtggccgcaacgcctgacagcatcatgaacagcagcaggaggagcgtaaggatatcggatggcgagctcgttttgcggattcttttgtcaaacagccttctgtacgtcaggatgacaagtccggtacatgccgcaatgcccgccggcaagccagcgccaatcgccattttgtgatacatatgctctgaaatgccaagggaagcatacacgccttctgggatcagaatccccatgacatgcccgccgacaacgcacagcagtccccagtgaaaaagtgtgctgcccgccgcaagttttttcttttctaacagctcgcttgatttcgccgtccagccaaattggtcatgctggtagcggtaaatatggccgccgataaagatcgtcaatacaatgtatggcataataccccagaggatctgcccgctcatgcctgaacagccccttcaacgctttcacgtacgccgatgttttcaagcgcggccagcagcacgtgcagcagttcagcgtatatactgttatttttttcgagacgggatgccagctccctcacattggacagatatttctcaaacacgcttctcgctgcttcaatttctgcagccgcagcaaattccagcatcagcggcagataatcaggcagctctttctctgtcggcaggaaaccggattgctcgtatgtgttttttaaatgcagcaattcaacgccgcgttccctttgctcgcccgagttaaagtaggtgacatacatatttgtttttttcccaaagtcgaatgtatagacatagtgttcaatcagcgcttccggtgaaaagctggctgacgcctcgaaaaagtgcagcagcttcttccggatttgccggttgccgatttcatggataagagccttccattcgggaatctcggctctccactcttcatccggataagagagaagagaggaaagagcggagaacgtcatttgccggtctgtggtgttcatcttgttacacctcatttatcaaaagttagaaacaggagccggggccgcctgaaaatgataagccgcagctcccttgttcagcatataaatctgaaacttcttctcgatgactgctcggtatcacaaagcggtcatcatatttggcaatcgcaagcagccgatacatatcttcaatttgctgttctgttaagccgacactggagatcagttccgggtcgattgatttattcgtctggttcgctctcatatactggcgcatgacagacattttctttaacgttgaccgaatatgatccgtatcaccggctgttaacagctgcgccaaataatcaatcgggattctcatttggtcgatagccggaaaaatatcttctgcggattgccggctgccttttccttcaaagagattcataatcggactgagcggcggaatgtaccacaccattggcagcgtgcggtactctgggtgaagcggcagcgcaatcttccagtcaatgatcattttatagatcggcgattgctgcgcagcctctatccattcagccggaatgccttgttcttttgccagtttggcaacctcaggatcatttggatcaagaaaaacgtccaattgggaatgatagagatccttttcattttcaacagatgccgcttcctccactttgtccgcgtcatacagcatgacgccgaggtagcggattctgccaacacacgtctcagagcagatggttggcagtcccgcctccaaacgcggaaagcagagtgtgcatttttccgctttgttcgtttgccagttaaaatagacttttttataaggacaggatgagacgcaatatctccatgaacggcatgcgttttgatccacaagcacaatgccgtcctcctcgcgtttgtacatggcgccggatggacaggatgagacgcacgccgggttgatgcagtgctcgcaaatacggggcaaatacatcataaagacctcatcgaattctgttttgatcgattcctccatcttttgtacgttgggatcttcaagtcccgttatgtggccgcccgcgagatcatcctcccagttcggtccccattcgatattcatgaaatcccccgtcaaggacgatttcgggcgtgctaccggctggtgttttttctgcgggctgttcgttaatgtttcataatcatagttccagggctcataataatcatcaatcgacggctgattcggattatagaaaaggcctgcaagccgattggttttcgagcccgatttcagctcgagctttccttttttcaatgtccagccgcctttatatttgtcctggtcctcccattgcttcgggtagccgatgcccggctttgtttctacattattgaagtacatatattccgcaccggaacggtttgtccacgtgtttttgcaggtgacgctgcacgtgtggcagccgatgcatttatccaagttcatgaccataccgatttgcgctttaatcttcaagccaatcgacctccttcagcttgcggatgacgacgttcaggtcgcgctgattccccgttggaccgtaataattaaagccgtagctgagctgggcatagcccccgatcatctgggtcggcttgacgtgtatccttgtcgggctgttatgggtgcctccgcggttattcgtcagctttgtgccgggcacgttgatgtggcggtcctgggcatggtgcataaacgccattcctttaggaatccgatgagacaaaaccgctctcgcgacgacaacaccgtttcggttaaagcattcaatccagtcgttgtctttgatatccgtgtcctctgcatcatctttattcatccacacggtcggcccgccgcggaacagcgtcagcatcggcagagaatcaaaatacatgctgtggacggaccatttattatgcggcgtcaaataattgaggacgatttcttttccctcttgatcaggccgcttgctcagaaacgggcgatgctggaggatcggtttgaatgtcgccatcgtttcaccgaattccatcatcagttcatgatcgacataataggattgtctgcctgtcagcgtccgccacgggattaatttttcaacattcgtcgtaaacggcgaatacctgcgccctcctttttcagagccggaaaacgctggagacgtgatcaccgttttcggctgggctgtaatttgttcgaacgtaaagcactcttcctcgcgttcttccgccaggtctttcagcttcaggttcgtgatgttttcaagtgattcccatgctttgacggcgacctttccattcgaagtggatgatagggttaaaatcgcttctgctgcctgctttgcttcacttatatttggacatccctttgcgacactgtccgaggtgattactcccaatctctgtttgagtgattcatattcatcggctattgaccagctcatcccttttgttccgctcggctttaaagcaacgttcggaccaagtgcagtcattttatgaaaaatgtgtttgtaatcccgttcaacgacttggatgttcggcatcgtttttcccggaatggcttcacattcgcctttgctccagtcattgattttgccgaatggctgggccaattcctgcatggtgtcgtggaggagcggcgtcgcaaccacttctttcacgggctccatatcgacttcttctgccagatcggaaacggcttttgacagcgccttgaaaatatcccagtctgacttcgattcccacggagccgagatcgcaggagcaaatggatgaatgaacggatgcatatccgtgctgctgagatcgtgtttttcataccatgtcgccgccggcagcacgatatcggaatacagcgccgtaccggccattcggaagtcaagattgattaacaagtcgagctttccttccggcgcctgctcccgccatttgatttcttcagggcggatgctgtcgctgtcgtcattcatcaaaccgttcgtcgtccccagcaaatgcttgagaaaatattcatgcccttttcctgagcttgagatcagatttgcccgccatacgaagagatttcttgggaaattcacttcattgtcgggatcttcaatcgcgaatttcaattttttctcttggagctgtgaggccacgtacgcaccaacgtcttcaggtgttgctgcccctgctttttcagcttctttatacagatcgatgccattttgattgaaagtcgggtaagacggaagccaccccagccgtgcggccagcacattgtaatcagcgtggtgcttgtagcgggatgacgcagcaatcggtgatgccaaatcactgatcggctggtcctcataacgccactgatctgtcgcaaagtagaaaaatgaggtgccgttttgcagcttgggcacgccctcccagtcctttgcagttgcaatcgtctgccacccttcagcaggtcggagcttttcctgccccacgtaatgggcccagcctccgccgtttacgccttgggcgcctacaagtaaaacaagatttaacactgctcggtagatcgtgtcggagttgaaccagtggttaatgccggcccctacgataatcatggaccggccgtctgtatcgatcgcattttgggcaaactctctggcaatcttaacgacagcttcttttttgattcctgtcatttgttcctgccaggcaggcgtaaacggctcagggtcatcataggagacagccgatcgttcgccgatgccccggttcacgccgtagttagccagtatcaagtcaaacacggtcgtgatgtacgtttcttcaccgttcaggttcatttttttaataggaagatcccgctcgagcactttgtttccgtcatttgaaaaatacgggatgcgcaccgtgccgatttcgtcctctattcccagcacagagagacggggttcaatcggttccccggtttcttcatcaatcatgtgcaggttccatttctgctgcccgtcccagcgcgagcccattgtcccttggggtatggcaaatgaacttgtctgttcatcccaaaccgcaggcttccactgatcatgctttgtcttccgcccgatgtccttcgcatgcagaaaccgtcccgctgtgtatacgccattttcttttgacagagtgacgagaaatggaaaatcagtgtattgcttcgcgtactcaataaaacgttcagtttcttggttcacgtaaaattcctgcagaataacgtgacccatcgccatcgcaagcgccccgtcagtcccttggcgaatactcagccagtcatccgcgaactttgaggattccgcaaaatctggactgatcgaaatgaccttagcgcctttatagcgggcctccgccaaaaaatgcgcgtcaggcgttctcgttaacggaacgttggagccccatgtgataatatagccggaattgtaccaatcactgctttccggaacgtccgtctggtcaccccaaatttgcggggatgctggaggaagatccgcataccagtcataaaaactgagcatagggcctccgattaacgacataaaccgggagcctgatgcgtggctgatcatggacatggccggaatcggagaaaaaccgacgtttcggtcaggcccgtatttcatcactgtatacagcagagaggctgaaatcagcttcagcacctccggccattcagcgcgcacaaaaccgcctttccctctcgcctgtttataggacttcgctttttcagggttttcgacgatcgatttccaggcttccaatggattttgatgcgtctgcaatgcctcccgccacaaattgatcagcacaccgcgcacgtatggatatttcacacgcagcgggctgtaaatataccatgaaaaactggccccccgcgggcagcctctcggttcaaaatcaggcatatccgggcctgttgatggataattcaaattttgcccttcccacgtgacaattccgtttttcacataaatattccagctgcaagaccctgtacagttaacgccgtgggtggagcgaacgactttgtcgtactgccatctgtttctgtatacattctcccaatcgcgatcttcgcgggtggtttggctatgtttatttgaatggtgttcgataggagagaaataattcaatctcctaaacaacggactccttttctttttcttcatgagagttcactccttccgagtcaggtgatgctaagttcactataaacagagacagcgtgtttccttgtgaactatgtcacacactctgcttttttcacaaaatgttcacacaaaggagaaggaaggctgcgttcaggcaggacgcttgggtcattagccgcctttcattcaaagatcaaaaaaaccggctctatttaagaaccgggctcggcgttttcatcctgtgatgtatgcagataccgcaaaaataattgataggaacaaaaaacattttgctgaagcatagccaaaaagttcatttgcagctgcggatgataagacatcattttcttaaatatgtaatatgggatgttgagaatcagaatgtctgaagtggcattgactgagataaagggcgataaataaagcccgcctttttcatcaatcggaaacacatcgcctttttcccacagcgcaacggttttcgacccttcagggagccttgtgtccataaaacggacactgccttttaatacaatataaacagattgagaatgaagaaaagatggagactgatcacatgaaccgcggataaacgtgccgtttttcagcaaggtttcgacaatggatagaggcacttcattaaacataggaagttgtttcagaaataataaatagtcacactgattcataggaaaacctcctgtgctaaggatagctttagtgtagctcgactgagcctgtacagcagtgatgtatttcacagcctgtatgatgaatgtcacttatcaggagggtgactgcatttataatgaaagaaaaaaggaggatttcgatgaaggcgctgattccgaagcagcacggcgcgtgggcgatgctgctgatcccatttttactcggcatggccaagggaggccccgttatttggcatattccgctcttcctaggctggcttttcctatacttagcggtttatcccgttacgcttgccttaaaaaagaaacaaagcaaaccatatcaaaagtggatgtgttattacggttttcccgcctgctgctttttgatgatctcggtctttcataagccgcctctcatctgggtgggcgtttctttactgccgctgtttctcatacatatgtattttgcccgccgaaaaaacgaacgagccctattgaatgatgttgcaggtgtcttgttcttttgttcgggcgggtttgcgagctgctggctggggatgggaaccctcgacggctgggcttggtttattttcttgcagtctgctttattttttatcgggagttccttttatgtgaaatcggtgattcgtgaaagaaaaaacaagacatttgcatactggtcatggggatatcacctgctgctcccctttttatccgctcttttcggagcaggatgggcatttctcgcttttatcctgagcagcttgcgagcatggttttttcatggcagggattggcccgtaaaaacgattggcattctggaaattgtgaatgcctgcttcttttttgccgtcatgtgcctctttatgacaaggtaaaaaaacaaggacaccgctgtccttgtttttttcagtcaatattgcaaatctccagcgggcaattttcacactcaatctcacatcgtaaatagtcccgcttgtgcaaaataatttttccggattcatctatcgaaataaccccttttttgcggagatctcccagcatacggttgatgctttcccgtgcagccgcgcaaaactttgccaaatcctgatttgtcaggacaatgttaatcagaatgccgtcgcttcgctccactccgtagctgtttgataaacggataagggtggaatagagcgccccctttttgccatgaagaagcagatccctgattttggactgaatcttccggaggtgcgtgctcatccatttcatgaactcaaatgtcaaagcgccgttttggattaattctttttccagcttatttttattaatgacgagcacctcgccatcctctagcacttttgcactgagcatatacctcggttcttcagtgaaaagtgttaattctccgacgatatcatgcttttggcagattctaagcgtcaggtcttttccgtcagatgtcagcttgccgatttcaatgagtcctgattgaatcagataaagctcttctgcatccattccttctcgaaacaaatacgtgtgtttttccatttttcttttcgtgctgatcgattccagcagttcatgcagatcgctggatataagatcactatcagatggtcgaacagagagaaaattcatgagctcacctcgaagaaagtcacgttgtgtgtttattgtaacgtgaattgatttgtacccatcgagaaaaaactaacaatcttgtgaatgccccagtgttagttgatgctctggctgtttctctccgtgtgtgttttcattctttcctgccaatacatccatatgacaaggacaaagctggctaacgccacctctgaaagcgccataaacccgatcgcgtactggcctgttgcctgaaatacactcgccaatatgagcggaggaaaaaagccgcctaatccgcccatggcagacacaatcccattggcaatccccgcttgcttcgaaaaatagaaaggcaccagtttaaaaacagtcccgtttcctatgcctgagcagacggccacggttaatgatccaaacgtataaaggccgattgtcggcgagaacgataggataatgcctgataatgtaagcccggcaaaaacaaacatcaagatgcggagcgggctcattttatcagccaggaatccgcctgcaggcctgagcagcgtagaaaccgcaataaagccagccgtccgcaagccggcatctgcaggattcagcccaaaatgctccaccagaaagttcggcagatagatagtgaaggcgacaaaggcaccgaacgtaataaaataaaacaggctcagaaaccatagcacatgattccggtaaacggctttgatttgagtcttaacagaaactttgaccttcttctcatgcctgtcaccgaacaaaacgtgcagtaaggcaaagacagccagcaaaaccagatacatctgcacggttgatttccacccgacggcttgagcgataaccggcgctgcaaatgtcgtaacggctgtcccgatatttcctgcaccgtaaatcccattgacgacaccgtgcttttctttcggataatatttcgggagggaggtcaccccaatggaaaacaccgctcccccgatccctaagaaaaagccgcctgcgattaaatcaaacagagaatccgcgatactgatccaaaatacaggaaataaaagcaggatgaagctaaccataaacatgagccgcgcgccaaacctgttcgttaaataccctaaaggaatgcggagaagcgacccgaggatcacaggaatcgccgtcaccaaagaaatctcacccttgcttaaatgaatatctaatgtgatttgggaaatgagtgatgaaatcagcacccaaaccataaaccctgccaccaagcttaatgactgtaacgataattgaatgtgttgacggttgatcatttggcttgcccctttcaatgattcaataatcagtcttatcatacaaaaactagccaaacaggattgtgaattacatcacacgtttttctcataaaaaaaggacaaagcccgaagactttgtccttttgatcgtgattacattttttccggagccgatacgccgatcagctgaagcgcattgttcagcgtaatttgcgttgccttcattaaagccaggcgcgcgcggcttttctcttcattttcagggtcgatgactttctctgcgttgtagaagctgtgcagagcagaagccagatcataaatatagttagtgacacggtgcggaattcgtttttccgctgcttccgccactgcctctgggaagccgccgatcgttttcagcagatcgtattctttttctgattgaatatggctgaaatcaagatctgccgccggtttaagcccctgctcttccccttggcgaagcatgctgcaaatacgtgcatgcgcgtattgtgcataatacacagggttttcgttagatgttgatacagcaagatctaagtcaaaatccatatgggtgtctgcacttcgcattgcaaagaagtaacgcacggcatccaagccgacttcttcaatcaggtcacgcatcgttacggctttaccggtccgtttgctcattttcattttctcgccgtttttgtaaaggtgaacgagctgaatgatttctacttcaagcgttcctttttcataccccagcgcttcgattgccgctttcatacgcgggatgtagccgtggtgatcggcgccccaaacgttgatcagcttatcaaagccgcggtcaagcttgtccttatgatacgcgatatcaggaagcaggtacgtgtacgtgccgtccttcttgatcaatacgcggtctttatcatcgccgaacgtcgtggaacggaaccaagtcgcgccgtcttcttcatagacatggcctttttcgcggagcgcttcaagcgccttgtcgatttttccattttggtacagtgaagtttctgaataccacacatcaaacggcacacggaagttttccaagtccttgcgaagcttttccagctcgtatttcaggccgtattcacggaaaaacgcgaggcgttcactttcctcttcgttaacgaaacgatcaccgtattcctcagcgagacgctttccgatcgcaatgatatcctcaccgcggtagccatcctccggcatcggtttttccaatccgagtgcttcaaagtaacggacttcaacagaaagcgccagattgttgatttggtttcccgcatcgttaatgtagtattcgcggcttacatcgtaacccgcttttgaaagcacgttgcacaaggaatcgccgacagccgccccgcgcgcatgcccgaggtgaaggtctcccgtcggattcgctgatacgaattctacctgaactcgttcaccgtttccgatgttcgtttccccgtatgcttcccctgcttccagtacagacggaatcagctttgttaaatattgattgttcatatagaaattgataaaacccgggccggcgatatccagtttttcaatcgaagccttccctttatcaaaatgggcgacaatctcttcagcgatttgacgcggcgctttttttgccactcttgccaactgcatcgccatattcgttgagtagtcgccgtgtgttttatctttcggtgtttctaaaacaacattgggaatctggctttcttcagccagtcccgctttcagaacggccgctttgatttcttctttcagcacgtccttcatttgttccgcaatgttcatgcgtgagttcctccctcatacgtgatcgtcatattatgtaaatgctcctgctcgtctccgacatgcatgtcatatgcgatgctgatacggcctttttcttcatcgagatcagattgaatcgattttgtgcttgttttcagctcaagctcaccaaatgacattttatatttagcaattgtggaagctcccgttacgaaacgctgattcattttgacagcgcctgacctcatgaccaggacttcgccttcgcttactttcacaatcgttttgactttgcctaagtcgtgttcttcataataagatagatacactttattttgttttacatagtaaaatccggtggtgcggaattcgatgacttcttggtttccgtcatcctcgatcacagacttcacatggagtgttatcggtgtctcttgcttcattctgacacgtccttttcatcattccactttgacttgaatagtataatcattcggtttgtaaacttcaactgcttctatcttaccatcattgctcatcagatttgaagataaacctcataaaaagcatttccttatatagaagagaaaatcatatcactaattacctttaggaaatgttacatttttccgaaatctatcatttccttttcacatttttttcaaaatatatgtattgaattagtaatttgatagttttaagataaaagtacaacatagatctgctagaaaaacaaaaaaagggaggattcaattatgaaaaaagctgtcattgtagaaaacaaaggttgtgcaacatgctcgatcggagccgcttgtctagtggacggtcctatccctgattttgaaattgccggtgcaacaggtctgttcggtctatgggggtaaggatctcccaaaagggcatagtcattctactatgccctttttaagtaaattacaatttttaactaaaatctacctcttggatatacatacacaaccgtttttcatttgaatcatatgtataggggatggtattttgtttatagagcagatgtttccatttattaatgaaagtgtaagagttcaccagcttcctgagggcggcgtgttagaaatcgactacttgcgcgataatgtctccatttctgactttgagtatttggatctcaacaaaacggcttacgagctctgcatgcgcatggatggccaaaaaacagctgagcagattttagctgagcaatgtgcagtgtatgatgaatcaccggaagaccataaagattggtattacgacatgctcaacatgctccagaacaagcaggttattcagcttggaaaccgggccagccgccatacaatcaccacgagcggaagcaatgaatttccgatgcccctgcacgccacctttgaactgacgcaccgctgtaatttgaaatgcgcccactgttatttggaaagctcacctgaagcgctcggcaccgtgtcgattgagcaattcaaaaaaacggctgatatgctgtttgataacggtgtattgacatgcgaaatcacaggcggagaaatttttgtccatccaaacgccaatgagattcttgactatgtgtgtaaaaagttcaaaaaagtcgctgtcttaacaaacggaacactcatgcgaaaagagagcctggagcttttgaagacttacaagcaaaaaatcatcgtcggcatttctcttgatagtgtcaattccgaggtccatgactcctttagagggagaaaaggctcttttgcccaaacttgtaaaacgataaaattgttgagtgaccacggtatatttgtcagagtcgccatgtctgtcttcgaaaaaaacatgtgggaaatccacgatatggcccaaaaggttcgggatctcggggcgaaggcgttttcttacaattgggttgatgatttcggaagaggcagagatattgtccatccaacgaaagacgccgagcagcaccgcaagtttatggaatacgagcaaaatgtgattgatgagtttaaagatctgattccgattattccctatgagagaaaacgcgcggcaaattgcggcgctggctggaagtccattgtgatcagcccgttcggcgaagtacgtccttgcgccctctttccaaaggaattttcattgggaaatatttttcatgattcctatgaaagcatctttaactcccctctcgttcataaactgtggcaagcgcaggcgccgcgattcagcgaacattgcatgaaagacaaatgcccgttcagcggctattgcggaggctgttacttaaaagggctgaactctaacaaatatcaccgaaaaaacatttgctcttgggcgaaaaatgaacaattagaagacgtggtccagcttatttaggagggaaacgatttgtcaccagcacaaagaagaattttactgtatatcctttcatttatctttgtcatcggcgcagtcgtctattttgtcaaaagcgactatctgtttacactgattttcattgccattgccattctgttcgggatgcgcgcgcggaaggctgactcgcgatgagcattttggatatacacgatgtatccgtttggtatgaacgggacaacgtcatcttagaacaagtggatttacatttagaaaaaggcgccgtttacgggttgcttggggtaaacggcgccggaaaaacgacactgattaatacgctgacaggcgtgaaccgcaatttcagcgggcgctttacactgtgcggaattgaagcggaggccggcatgccgcagaaaacatcagatcagctgaagactcaccgttacttcgccgccgattatccgctgctatttacagaaattacggcgaaggactatgtgtctttcgtccattcgctttatcaaaaggatttttcagagcagcagtttgccagtttggccgaggcctttcatttttcgaaatacatcaacaggagaatttcagagctgtccttggggaacaggcaaaaggttgtattaatgacaggcttattgctgcgcgctcccctgtttattttggatgagccgctcgtcggtttggatgtggaatcgattgaggttttttatcaaaaaatgcgcgagtactgtgaagcaggcgggaccattttgttttcttctcatctgctcgatgtcgtgcaaagattttgtgattatgcggctattcttcacaacaaacagatccaaaaggtcattccgattggagaggagaccgatctgcggcgggaattttttgaggtgatcggccatgaataacataatccccatcatgtctttgctgttcaaacagctttacagccggcaagggaaaaaggacgccatccgcattgccgcaggccttgtcattctggccgtgtttgaaatcgggctgatccgccaggccggcattgatgaatcggtgttgcgcaaaacgtatatcatactcgcgcttctcttaatgaacgcatatatggtgtttctttctgtgacatctcaatggaaggaatcttatatgaaactgagctgcctgctgccgatttcttcacggagcttttggctcgcccagagtgtcgttttgtttgtcgatacctgtttgagaagaactttattcttttttattttaccgctgttcttatttggaaacggaacgctgtcaggggcgcaaacattgttttggctcggcaggttttcgttttttaccgtttactccattattttcggagttgtgctaagcaaccacttcgtcaaaaagaagaacttgatgtttctgctgcatgcggcgatattcgcctgtgtatgtatcagcgccgctttgatgccggccgccacgcttccgctttgcgcggtgcatatactgtgggcggtgatcattgactttcctgtctttctgcaggcgcctccgcagcagagcaagatgcattcatttatgcggcgatctgaattttcgttttacaaaagagaatggaaccgatttatctcttctaaagcgatgctgttaaattacgcggtgatggcggcgttcagcggcttcttttcgttccagatgatgaataccggcatcttcaatcaacaagtgatttatatcgtgatttccgcgcttttgctcatcagctcaccaatcgcccttttgtattcgattgaaaaaaacgaccggatgctgcttatcacgcttccgatcaagcggaaaacgatgttttgggcgaaatatcgcttttattcaggcctattggcaggcggatttctccttgtcgtgatgattgtgggtttcatcagcggccgtccgatttcagttctcacttttttgcagtgcattgagttgctgctggcgggagcttttatcaggttaactgcggatgaaaaaaggccctccttcagctggcagacggagcagcagctatggagcggtttctcaaaatatcggtcttatctgttttgtcttcccctattcttagccacattagccggcaccgctgtatccttggcggtcattccgatagccggtctggtcatagtctattacctgcaaaaacaggatggtggtttctttgatacaagcaaaagagaacggcttggaagttaacctgctgaagactcatcaattttcaactatttcaatcgccgcgagctttctgaaaccaatcgaaagcgcggcggaacctgaggaagaaacgatttatttttacggcgccgccgcatacctgaaggagcaaatcattgacgcttttggttgtgctgccggcagccgtttcatgtactcagcgaatctcttttttgatcagcagctgaaaacctgcgggacccgtttgattcacccattatataacgggaatcttcatgttgacgccctgctgaaaacttttgcagacttgtctttcccttcttctctttcattcgaagcagttgaaaaggccaggaatgagctgctgctgagaatcgaaaagaaattcactgatcctttctcctactcggcggcgcgcttggctgaggaggtcttcggaaacccgatgtacggcacaggcatgtttggccggaaagacaggataaaggcgattcatcctaaacggtttctcgacgcaacggactttatcgttgatttagtgtcccagcaaaaacagctgaacatattgggacaagtacaagcatgtgatgttcggggacatgccccgcaaacgtccgctataacgtccgaaagaatacccgtaaaccggcatgtttttgaaacagagacacgcagcgctgcaggtccttccgtcttgacactcggatttgactgcggagagatgaaagatgccagcgattatatcaaaatacagctaatagacggattactgggaaagtacggccattccgctttattcaagcacttcagagagaaggatctggcagtctatcacgttatcacccgttacgatgtcatgaacaatttgctgcttgtttcaatatgtacagatcagcttcatgagatagacattcccccgcgcgttttggaagctgtctcagcttttcatacagatgagcgggaactagaacaggcaaagcagtttttacgcaatgaattgctgctgcaattcgattctcccgaaggtctattggcctatatggggatcctgcgccgcttctcctgcacgaaagaagccttgctggatggcatctcagcagttacatgccgtgatgtattgcaattcatagcgaccatcaattatatcggagctcatgtagtaaggggatgaagagatggaaaagaaagccttttttcaacaactggatgaacgaaccgatatcagatacacagacagcggactaaaaatattcagattgaaattcccccgcgcccacctgcggctgtgcaatgtaaaaatcgattttggaagccgggatgtatgtatacgggcaaaatccggtgatacactgcttccgtatggcacagcgcattttttagagcatcttctcttctggcataacggccgcaatctgtacagtgatttttttgcgcatggcgcgcttttaaacgcattcactacctacaccgataccaatttcatgtttacctcattaccggatcggctcaaacaaacgatccccatcctgcttgatgctttatggaaccactcatttgacaagaagattgtcgctcaggaaaaagctgtgattacaagcgaaattcaaacagcacaccttaaccatcagctctcatatcattatcagctgatcagcatgctttctccctcctcaccagctgccgttttccccgcaggcagaatcgaagatattgaggcgctggacatcaatgatttacaaaaagcctataaggctgcctaccaagcccatcggatgacactgtttttgattgggggctcagaaaatacagaaacgcttttgcctcctcacctccagctggaaaagcgtccggattatcatgctgaaagaaaaatcatcccggcatgccctccagccctctcacaaaaaatggtgctgggtgatgaggagcggatggaagatacctggaccggattacagatcggcgcacttcccgggcaaaacgatctgttgtcgataaagctttattgggatatcgcggctcgtattctatttcaattagattcaccattttttcaagagattcagcaaacgtaccgtctggaaatcgatcgcttgtcagccgagacttatatatatgaggatggcggtttcttgatccttcacagtcaagggacccattcttcagcttatatcgatgtggcttcatactatgtcacacagaagaaagaacaggttgccgcctggcttcaatacggcaaggactctttgacagacgcgatcatttatgacagcgattatgtgcgtaaatgcttcgagtgggcagccgagtgtgacaggtgcgattgctcgtttcttgacatgtaccacatcattcaagatatggatgcgcaggttttcttgtctctcattgatgcaatggcatcttctaacaaagcgatcattcacgtttctcagaaagaggcgatcagacaatgaaaaaaaacactgtctttacccttttattgctgcttataggtatggcggcttattccttcggctgggttcaggccgttgccgaagccgccgcccaatatgtacagatgatcaacaatgatgctgtgcggctcggactgctggcttgtaccgctgccctcctgatgctgcctgcttttctctatcttcattatgtcacccaatccgtgaaaaacatgacagcagcttttcagaaactcacacagtctcatcaaagctgctgtgactttcagcaacacaacttgtgcagccgatatgcagaagacgtcaaatcgctgcgtgacagctataaaaacgtccgccaaacatacgtgatggctgccgtgttgtgccaagtcttcatattcggctgcatgttcgaaatcgttaaagccgtccctttccgccttcacacgccccctgccctttcaatgggacttgcgatgctactgattctgtatttattgttttgcatgcgaacttatttgcggcagcttttccggcacggcagcctgttcagaaaagtgtttgcgggagcgctggcagcagccgggatttggtggatgctcagtttctctataagtgaactgctgtttctgattatcctggctaccattcagcaaatcggatcatttatttataaacgattctcttatcgcagcaccgcttctcttgatctataaaatagctacatcgcaatcgcagacggacccgcgccaaccggaatcaccgtcacggctgtataatcacttgtgcggtacacggtcacagcattgtcgttgggctgtgccgcataaaaatactgtttgtccggcgttacggcgaggtcaaaagcgccggggagagacacgtttgcaatgatcctctgtctggccgtattaactacatataagttattaataagaaacggttcactatatggctctagaaaataagctctagtgctatcgagagaaaatacaatcgtcctcagcgtttcaaataaacggctgaagtcccctcccctgcttaatggagacaaactaatctccgttacacctttcggccacagctcaccattcaacacgtacgcaaaatttccagcgtaaggagttgcaattaaactgggaaattcaaatgtatctatgatactttctaccaactgcccagtatttatatcatatttatcaaccgaccaactgcttccattagcggtatagacatactgtccattcggatcaagagcaaagtctaaagcgccgggtatcggaatgacatcaatgaccgattgagaggccgtgttaatcacatatatagatccggcggccatcacgtatgcgaactcatcttttggatcaaattcgatctttctcggccctcctccaacagtaatggtatttatgatggttaatgttttattatcaatcactgagacaaggttggtatttccatggaggacatacgtgaatgctttatcgaaagtaacgcctagattagttggcacgtcagaaaaagggattgtttttacaacagtgtttaaatctgcatcaataaccgaaaccgtgctgtctccagtattggcagtaaacacatacgattgagggtctggtgatggcggtaaaacaagtgtcccggtcaccgtaagcggactgccgtagaaaggcggtacaatgagcagatcttccactgttatttgactgaaatcaggacagcggccagactgtgctgcataataaacaacttgatcaatctcttcggtatgaatcacagaaaccgccccattgccttgtccatattgatttcgtacaggcgacacactgacaagaagcgtaatggtcccttgtactctcacagcatatcgaacaccgatatcttctggttccggcccagtctggattaagcaaggctcactgatacaggacacattgtctgtactccatgtaacagccgctgacgcttcggccgaatcaaccttgaagccctcagggatatctatcggcacttgaaacggcgcttctcggctaatttcctcatcacaaaaacagaaacaattttcctgtaaagcagaaagatcattctttttcatgatttcacgtccttttagaaatgcacaacatgcagcggttaaatcgtaatggcacccggtgaaaccccaagagatatcacagtttcctcagaataatcatctgtgttgtaaacaatgatgctctgctctataaaacgagttgcatacagaaaatcgccattcggggtaaacgcatagtctgttgctgattgcggaagatttccaattacacctgctccattcggactgacagaatataaattgccagtgaagctgtcatgtaaatacacctctgatccactcgtaaacattacatatagcccgtcaggctccagctcttgggtatccctgatcgtaaacgtatttaaatcaataaccgtcaaataattgaataagaattcttgttctaatacatacgcataccgctccgtagaatctgtttctatggatgatacgataagctctcgttcaatcgttcctaagacttcaccggtagataagtccactttttgcactaacccaaaattaagaacataggcgaacaacccattggggtcaattgcaatatcaaaaccttctacaggaatagacctctcaacagtcaacgtatcaattccaatcacataaatggcagtaccggtgaaaacataagcaaactcatgattagggataaatctaatcaatcgaggcggctgatccagcaatatagttgctgtcactgttaatgtgtcataatcgatgacagaaatcacattattgttgggatgtaagacaaacacagcgcttttatctggcgtaatttcaatacctgccggattgtacggaagagcaatcgttgtcacaacagtatgggtgtttgtatcaatcacagaaactgattgatcatttggattcgctgtaaacgcgtagacgggttccggctccggtacaagcacaatcgtccccgtcaccgataaaggactgccgtaaaacggcggaacaacaacaaggttctcaatcgtgatgtcactgatatccgggcaatcatccggttcatcggaataatagacgacttgatcgatttctgcattgtgaatgacggaaacagccccgtccccttgtccatattgatttcgcacaggtgagacactgacgagtagcgtaacggttccctgcaggcgcactgcaaattgaacaccgacctcatcaggctctggccccgtttgaattaagcaacggtcactgacacaagaaaggctgtctgcattccacgtcacgtttgcaacagcttcagccggatcaacgacaaatccttcaggtaactcaatcggcgcttgaaacatggcttctcggcttgcttctccctcacaaaaacataagcactcttcttgttctgctcctgctttttctttaaaggaaagcttattttttctcataccttcacttccttttcagacatacactgctcacgcagatataacagaatatggaagagtaacgtgtttgcttgtacaaattactgagggtaaaagcttctttttgaaaatatatctccaaacatgcggtgtaacgaaagaaaaaattgcggtttttttgcgcttctcacaagaatgttgatgataaaatatgacatatatagaattatgaagggagggatttgcaaacgtgacaggtgtcatatcttcttcttccatcggagaaaagattaacgaatggtatatgtacatacgccgattcagcatacccgatgcagaatatttgcgacgagaaatcaagcaagagctggatcaaatggaagaagatcaagaccttcatttgtactattcactgatggagtttcggcacaacctaatgcttgagtaccttgaaccgttagaaaaaatgaggattgaggaacagccgagactgtctgatctgctgcttgagattgataaaaaacaggctcgtttaactggtctgcttgagtactattttaatttcttcagaggcatgtatgagctggatcagcgggaatatctgtcggctattaaatttttcaaaaaggccgaaagcaagctgatattcgttaaggatcggatagagaaagctgagtttttctttaagatgtctgaatcttattactatatgaaacaaacgtatttttcaatggactatgcacggcaagcatatgaaatatacaaagaaaatgaagcttataatataagattgctgcagtgtcattctttatttgccaccaattttttagatttaaaacagtatgaggatgccgtctcacattttcaaaaagcttattctatggcagaagctgaaaagcagccccaattaatgggaagaactttgtacaatatcgggctttgtaaaaacagccaaagccaatatgaggatgccataacatatttcaaaagagcaatagctgtttttgaagaatcaaatattcttccttccttacctcaagcgtattttttaattacacagatccattataaattaggaaaaatggataaagctcatgaatatcatagtaagggaatggcttattcacaaaaggccggagatgtaatatatttatcagagtttgaatttttgaaatctttatacttatcaggcccggatgaagaagcaattcaaggattttttgattttctcgaaagtaaaatgttgtatgctgatcttgaagatttcgctattgatgtggcaaaatattatcatgaacgtaaaaattttcaaaaagcttctgcttattttttgaaggtggaacaagtaaggcaacttattcaaggaggagtgagtttgtatgaaattgaagtctaaactattactctcttgtctggctctaagcactgtgttcgtggcaacaactattgcaaatgcacctacacaccaaattgaagttgcacaacgaggaatgatttaaacacttaaaatataaaaagggaaatgttatttcgttaacatttccctttttatatttattcacttagaaatttatcagccttttcacttcctttaaattaaatattaataaacaaatgaatttttccttaaatttcatttacttttcctgtattatacattattatatataggacttaagttatctataatcttcaattgaagaatactcggaggaataataacaaatgaaatttacagttaaaaaacatataagtaaaatgtttataatatttgggcttgctgtttcatcttttggagtcacaagtgctgtgcatgccgctgccaatacttctgattcaactgtccattttacttttagagtatggtctccttatgattatacaactgcacgcagaaaacagaacaaaagctctatgtatatgaaagtgataagctctgacaagaacagcagttttaatgtttggactgaagcagatgctaacgttcactctaaaggacgagactggaaaaacgtatctggaaaaaaacatgaaggagaggtaaagccaggaaacacttatttatttgtgaacacagcagttgaaagttatggtaaaaatgttcccgtacgatttggtggttacagctgggaaaataatgcgtacaaaacaaattggagtcctgacagtgttaaacctaaaggcaaatacatagaatattaatggaattttgcttctaaatagggtttgagcggttttacgatatgtaaaaccgctttttaaagtttatttttcccttaaattaatcatgatgatttataaatgtggtaatatatgaaaatgattaccttaattcattttaataacaggaggtataaatatgacctattttttcatttacaggcttctaaaaagcaagacactatatttttcacttatatttagtactctcatagtactataccagtacttggatattgtagtgtttaataatcatacaaatctgccttacgaagttcacaaatcaccttttttatcgaacatattacagggtaattctgttattccttcaacagtatggttgatgatacttcctattttggctaccttgccaattacaagtctatatagatttgatgtgaattctggatattttatgaacactataataaaaacaactaaaagcaaatactttaatacacttatcgtgtttaatttcttgtgctcttttttgattattataattcctttaagtattaatttatatttatttttgatgacttatccatccattaaacctgatggaatcataaattacatgcaaaatgtggtttctaatggtagtgaccttgctaacatttattatgaacatccactgctctatacgttaatcctaatacttataaatggactatacggtgctatcttatcaacagtcgggctatctttttcttttttcattaaaaaaacttattttgtatatattataccttttgttgtgaatttacttggcattactatcttgaatccagattataatcctcaaagatatattattaataaaaatggtttttttaatttgcaaattttttctttattaaacttagtattaattatattaggtcttttaatatttttatggggtaaaaagcgccgtgttttattataatcttttaaaacaaaaattcataagcaaatattttggtttttctatactcttttctatcaatgctataattatatttatattttttaagagatcaatacagacgcaaaatgaccatattatcgatcaaatctttacatatcagcatcttgtattattgatagctccattaattgtagtatttactctattagtgtcttccgattatttcatggatcatgccgtgattcggctgaatagttcatttaagatagtagggtactatttccttaaaagcatttctttttcagctatactaggcattatcgttatgggagaaatctatatattgtgctttacatataatattgataataatctgttaactgttagtaattttttaactcatgtattcgcctatatattcattgcttacttgacatcgtttttaatccttttaacaaatcaaatattagttgtaataatagaaataattttatttttgtttgattatctagaatgtaacggcattctcttcttaaacggatttttattaaattttgatgttttaaaggatctattggtattcagagtagggctgatgtttattttgttcggagtgtgtattcaaatagttaaaaaacaagactatttgaggcctaacgaccagaaaggaacgtactgatgcattctatttttcatttgttaaaaagggatattatgatgaggctgcatgattgtaaagcaacttttctttttataagtttagcagctttgctagtctattttgtttctttttggaatagttataaatctggccaactagaccagcacaatcttttaaataattatatgaatgtctttcattcactaaacttttttgaattacatgagctttattcacaacataaattttcaatcccctttacgtggatttgccttcagctattccctttacttattattgggcatttttcatataatgactttcaaaaatcaggaactttattaatacctaaattaaacaataaattagctttttggttaagcaaagtgttttccttatggtttttttgcttgataatctggattgtctggttttcattctatttcattttctttctaatattcaaaggcacaataacaattggagagatcaaacctgttctttctttaatgttaattcaatattcagtgacagctgtttatactctagtttttgaaacattaacgtatttcttttcgtttattatttcattagttatttcaattgtgtatctcatcatatccatatttgttcattcaaaattcttttttacctcgttagccataccaggcagatggtatttcgccgatcattcatcaataaatatgagttattctaatggctctgctattcatttgccaatatttattggtgtaattgctttattttgcatcttatgctgctttgtaggaatgattcgcataaaaaaaatagacattttaggagattaattatgactgcatttatagaatgtacaaatgtatataagaagttaaaaggaaatcttgtacttaatgatattaatttaactatcaaaaaaaatgagtttgtagtattaaaaggacataatggctctggaaaaacaatgattttaagagcaatcgcagggcttttaaaattaaccaaagggcaaattattgtcaataatctcgttataggaaaagatacagatttttccataaatactgggatattaattgaatatcccagttttatacctgtctataccggttatcaaaatttgaaattcttagcttcaattaataagaaagtttcagaccaagagatccgaaaaatgatagagcaagtaggattagatcctgaagacaaacgtaaggtaaaacgttattccttaggaatgaagcaacgtttaggcctagcacaagcactaatggagtctccatcactgctgcttttagatgaaccgactaacgcactcgacaaaaaaggaattcagctaatcactgatttattgaaaaaagaaaaagaaaagggaactacaatagtcgttgcaagtcatgatgaaaccctgactgaaaataatattgtagacagagttatacatattagcaatggtagactgggtgaggataatgaataaacgagcaatattgttaataaccatttttttaattattgttgctggtagtagttttcgttattataaactgaataatcataatgataattactctcctcatatcacaaaccttccgaaaaatcgtatgatcgatacgggcgccgggattacttatcatgttctcaaaccattaaaaccaattgaatttatggatgaggatcttaatatgaaaagattattatacattttgccgctggatataacaaatacatccaagcacgaaataacgctggaacagctctcacctgatggaatgaaatatcttttttttggtggctttgatcactattacaatttaatggcgtataatttagatcttccagaaaagtatcaattcaatacttctattcctgctgggaaaactatacgaggctatgtcggtttgaaaatgacaaaaggcaaagacgtaaactttaactataaaaattttgatcccacaacctctaaattatttgtttattattccttgataaacaaatcaaataaaaggataacatataaattcccacttaattaatctggtattacaattcaggaaatcaattcatatttcctgaattgtatttttatattctcttccttctctcctgaaaagttaaattatagaattcaatatctttcaatttaattttcatctatattgatatgatgattgccaacaccgcttcaataattttcattgaaaatcataataattcaaaacctcttatctccttaattcattccacttcaagcacctattaagattaaaaaaaataaaacaagcccgtactgaatggcttataccagtcaacacgggcctaccttcttatttcacaaacccaagcagcatttcacggatgattttgctggctgtgtttgccgtttgctctgagtggtcatacaccggtgcgacttccactaaatcagcgccctttacgtttacctctgaacgcgcaatttcatggacggatgcaagcagttctttagacgtgatgccgccggcgtcaaccgttcctgtacccggtgcgtgtgcagggtctaatacgtcaatgtcaattgtgacataaaccggacggcccgccagcttcggaagcacctctttcagcggttcaagcacttcaaattttgagatgtgcatgccgttttccttcgcccattcaaactcttctttcatgccggaacggattccgaatgaatacacattgtgcggtccgatcaattctgccgccttacggatcggcgtggagtgagaaagcggttctccctcataatcaacacgaagatctgtatgtgcgtcaaaatggataatcgcaaggtctgggtatttcttgtacatcgctttaatgacaggccatgtcacgaggtgctccccgcccatacccattgggaacttccctttttctaaaatgctgtccacgtactcttcaatcatatccaggcttcgctgcggatttccgaacggcagcggaatgtcgccggcgtcaaagaaattcaagtcagccagatcgcggtctaaatatgggctgtattcctcaaggccgattgacacctcacggattctgcttgggccaaagcgtgagcccgggcgatagctgactgtccagtccattggcatgccgtaaagaatggcgtccgcctcttcccactcgggacggctcgcgataaatacttttcctgaataagcttcatcaaatctcatctataataccctcgctttcctgtaaaaaagcgcaagattcgctcctgcgccataccttcattatttaatcaggtcactcacaaatttcggcagaacaaacgccgctttatgaatatcttttgtgtaatatttcgtctcaatatcgaagaaacggctgtcttccactgcaagcggatcatattttttcgagccaattgtaaatgtccacaaaccgcttgggtatgtcggaatgttcgccgtatacagcttcgtaatcgggaagatttccttcacgtcgcgctgtacatttgtgattaattccggtgtaaaccatgggttgtccgtctgcgcaacgaaaataccgtcttctttcagcgcttttgcgattcctgcgtagaatccttttgtaaacaggtttacagccggtccgactggttcagttgaatctaccatgatgacgtcgtattgattttcagattttgcaatgtgcataaatccgtcatctacctgcacgtcaacgcgcggatcatccagtttgcctgcgatagaaggaaggaactttttagagtattcgataaccttgccgtcaatatctacaagtgtcgcttttttcacgcttgggtgcttcaggatttctctgataacgccgccgtcaccgccgccgactacgagaacgtgctccggatttgggtgcgtaaataatggcacatgcgccaccatttcgtgataaacgaattcgtctttttcagatgtcatcaccatgccgtccaaaaacagcatgttgccgaactcttctgtttccaccatttctaaatgctgaaactccgtttgttctgtatgtaacgtcttgttaaccttcatcgtaatgccaaagtttttcgtctgcttctctgtgtaccaaagttcgctcaattgtcatctccctttcgaggctgtattcatttattgtaagcgtcttatcagcttttattctcggttgaaatctcattttcacctaaggaaaaagtatagaggatggcggggaaaaagtaaagatgcgtcctgttctgcgatgtttaaaaacgatctttttttctcataatagtagaaacataaaaaaagggggaacccgttgtggatgcaatgacaaataaacggctgagactgacgctgaaaaccgttcgcgcctttatctttttaggggcttttgcggccttggcggcagctgccgtgtttatgactgtcattttgatagccaaataccagggcgctccctcggtgcaagtgccgcaatccacgattttgtatgcgagtgacggctcaaagctcggggaaacgaactacggcgaaaagcgctattgggtccccttaaaggacatgaatccgacgatcgtaaaagcgacagtggcgattgaagaccagaatttctacgatcatcacggctttgattataaacgcatggccggcgcggcgcttgctgacctcaaagcatttgccaaggttcagggtgcaagcaccatcacccagcaatatgcgagaaacttataccttgaacacgacaaaacgtggaaacggaaatggaatgaggcgttctacacgatccgtctggaacaaaactattctaaggacgagatattagaaggctatttaaatacgatttactacggacacggcgcctacggcattgaagcagcttcccgcctgtatttcggcaagcatgccaaaaacctgacggatgcggaggcggcgcttttggcaggtatcccgaaaggcccttccggctattcaccgtatgtcaatgagacgaaggccaaggaacgccagaaaacgattgtgcggatgatggaaaagcagcagatgatcagccaaaagaaagcggatgaattgatcaaggaacctctttcctatcagcctttgaataagcaagtttccaagagaaaggctccttatttctacgacaatgcgatgagagagctggagaaaaagctcggcatgacacgggagcaaattgaaacgagcgggttaaacgtctatacaacggtagataaacggatgcagcgcatcgccgaggagaccattaccgaaacggttaacgcgggctctgacattcaagtcgggttttcagccattgatccccgcaccggaaacgttctcgcccttgtcggcggcagggattatcaaaaaagcccgtttgaccggacgacacaggcgaagcgccagcctgcttcgacgatcaagccgttgctgtactataaagcgattcagagcggatttacgccagtcactttgatgaaaagcgaagaaaccgagtttcaaattgatgcaaagggagaaacctattctccaagcaactataacggatactatgccaacaagccgattacgcttctgcaggcgctggcgctttccgacaatatttacgctgtgaaaacgcatctttttctcggcacgaacaaacttgtaaagacggcaaaggaattcggcattaccgcccatcttcaagcactgccgtccctggcactcggcaccgaacccgtacgtccgattgagatggtcaatgcctatgccatgctcgcaaatggcggaaagaaaatcgaaccgacttttatttcaagagtaacggacgcagccggccacgtgctgtacgaaaacccgaatcagcataaacaggtgcttgatgaaaaagccgcgtttgtcacagcgagtatgatgacaggcatgtttgataccgatttaaatggatatacgtcggttacggggcgaacgatagccaaccgcctgacaagaacgtatgccggaaaatcaggaaccaccagcgcagacagctggatgatcggcttcaatccgaagctggccgcaggtgtttggaccggctatgacaaaaacagcaccatcgactcggtcgaagaaaaaagctatgctaaaaccatttgggcggacttcatggaggacgcgctcaaaggcgaaccagaaaccgcgttcaagccgccaaaaggcgtaaccggtgtgtacattgatccggaaacaggctactcatcaggtcccggctgtgccgctaagcattacacatattttgtgaaaggcacagaaccagcaaacatgtgctacggggcagaacccgcaaaacaaataaaagaccggcttccatccaaagaaaagcccgcttccgagaaaaagtggtgggacaaatggctggggcgacatcattgaaaataacccggctcctcggagaccgggttattcgtatggttccttcataatcgatggaagaatgttagacaatcgagctgaacaatcagttttgggataaagtggtgaatttctcatttcttcgacgccggctttcatctcccagtcgccgactcatatccccctaaaaatgaaaaaccccgagtcttgtttcggctcgggattttccatgtcctatttctgtatcaccagtttactcaatgtttacgaaaaatatctcaaatactttaaaagttcacagaaaattcacaaattaatcatcttctggaagcaggcttgtttttaattcatctgaggaacggtcccataggccctgatcatgctttttcagaaattcacctagtacacgcttcgagctgtcgtccattttatcaacgatgattttccgtttcatggatttatccatcaaattcacatgctcaggcagcgacttgtagcctcttctgatgcttctgtcgaccgtcatttcacaggctgtcacaccagcgtaataaggcccctcttcttttctgtcaatcgttacccacacaagccagtatggttttccgttcggcacttcttctttatccgggagaaatttaattcctttttcaacggtgctgcgggcatgcatggcgccgatgtctacgaacgcttctttttcttctacatcaacgaatacgggagaaatgttatcaaggctgagtgcccctacgccaaaaccgccgtgtccgtctgtcggatcacttttgataatattaaacccgattgattttttctttttttcttccatgaagttctacctcctacaaaagcggttgaaatatcgctgaaaacagctttaaaatcgaatctcttcctgcattgagcatcggccacagcacgtaagatccgagcggtgtcacaaacagcaccaaaaatacgataaagccgtagctctccgcctgcgtcattttggcacgcacgcccggcggaacgagatcttctataattcgatagccatcgagcggaggaagcggcagcagattaaataaaaacaagacaagattcagctgtatccaaatagaaaaaaactgatccagccccgtgctgaacgccgcaagcatttccattccgtacgcatgcatcaacactaacaaaaagaaaccaataaacgcaagaatcaggttactgacgggcccggctatagatacgagcacaccggcaagccggggtttcttaaagaagcggcgattcacgggaatggggcgcgcccacccgaagccggccaccaaaatcaaaatggttccgaacggatcaaggtgtttaatgggattcagcgtcagtcttccttgttttttcgccgtatcgtcaccgaatttgtatgcgacataagcgtgggcaagctcgtgcatcgtaaacgacacaattagcgtgatgacgaggtatggcattaaagataacggataatataaaaaacggtccaagtgagatatccctctttctcaaaatgcaagaatttactttattcagtatactataagaagcctctttttctaaagagaggaaacgagataaaggaggattcagcacccatgccatacgtaactgtcaaaatgctcgaaggccgtacagacgagcaaaaacgcaatcttgtcgagaaagtaacagaagccgtaaaggaaacaaccggtgcttctgaagaaaaaattgttgtctttatagaagaaatgagaaaagaccattatgccgtcgcaggcaaacgcctgagcgatatggaataatctctataaagccggcgcttcgcgcaccggcttttattatccctattgagccagcttcgcaataatcgccaagaacgtctctttctcttcggctgttaaacgttcaaacatgccgtcaatcagctgctggcggttttcgatcatttgttcagccgctccccggcccgattcagaaagcgtaatccatacagtgcggcggtcattgttatttctggatctctcaataaacccttcctgctctaaatgattcagagctgtggtcgtggctgagggagacagtgtgacctccttcaaaatatcctttatggtgcagctcccatgtctgtatatgatccgcagaataaaccctcttacattattcacgtgtttcggaacggtggcttcatctaattgcttcgtgcttttcaaatattttgtaagtgcgtgatccagcaaatttgcttccagtttgtcatggtccatgtcaatttccccatttcgagatgcattcataacatacgaacgatatgatttacttattattttactgattccgaatagggaaagtcaaaaaagcaaaatgtgaattcacagcttttatcctacatgcctcgattttccacctgtttcacaagcttatctttgaatgtctgaaaagaaacgtgttcattctgctgatgtccgaatcggcggacgtttaccgcattctcctgctcctcatgatctccaagcaccagcacgtacggaattttttgcacctgcgattctctgattttatagcccagcttctcattgcgctcatcaatgccggctcttatccccgcctgcttcagctccgcctgtacctttctgcaatagtctaagtgaacgtgagaaaccggtatgatttgaacctggagcggtgcgagccagactggaaaagccccgccgtaatgctcgatcaaaatgccgaagaaacggtcgattgagccgaaaaccgctctgtggatgacaacgggacgaaccttttcattgtgttcgttgatatatgttaaatcaaatttttccggcatttgaaaatcaagctgaatagtcgcgcattggtggctccgtttcagggcatcttttatgtggaaatcaattttcggcccgtaaaacgccccatcgccttcattgatctcataagagaggccaagctcctcaaggacgcgtgctaaggcacgttccgacgcttcccaaaggctgtcattgcctaatgaatcctccgggcgagtcgaaagctcaactgaatactcgaaaccaaatgtccgatatacctcatcaatcagccgaatcgcttctttgatctcactctcaatctgatcctcccgaacgaaaatatgggcgtcatcctgacagaacgtccgaacgcgaagcattccgtttaaagcgccgctgtattcatggcggtgcacctgtccgaattccgccatgcgaatcggcagatcccgataagaatacaggctgtttttaaagatgagcatgtggccggggcaattcatcggcttcattgcgaatcttgtatcatccacttctgaaaagtacatattgtcgcgataatggtcccaatggcctgactgctcccataaccgctgattcatcataaacggcgtacgcacctcatcgtagccggcatttgtttgcagctcacgcgagaagcgctccagctcattgcggacaatctgccctttcggcaaataaaacggcatccccggcgcttcttcagaaaacataaacagccctaactgtttgccgagcttgcgatggtctcgttttgccgcttcttccagcatatgcaggtgcgcatccaaatcttttttcttttgaaacgcaaccccgtacacccgctgcaggacttcatttttgctgtctccgcgccaataagcgcctgatactcttgtcagtttgaacgccttgatcatccctgtagaaggaagatgcggcccgcggcacaggtcaacgaattccccttgctggtacagtgtgatatcctccccgcgcggaatattctttaaaatctcaagcttaagccgctcgcctttttgtgcaaacagctcttcagcctcttcgtaagaaacctctatacgtttgatttcaaggttctcatttattatgtgttccatttctttttcgatggcctctaagtctcctgatgccaagcttttccccagcttcatgtcatagtagaagccgtctagaatcacaggccctacccccaatgacacttcgccgtacagccgttttactgcttgggccagcacgtgcgctgttgtgtggcgaagcacctgcaagccttcttgtgaatcgagtgtgacaatcgaaagctcagcatcctcctccagcttgaaactgagatcaacaagcttgccgttgacctgacctgcggccgccttcttttgcagactggaactgatagaaccagccgcttctttgattgtgatgcctttcggatattcctggatctgtccgtccggaagctgaatgtctacatgtttactcattttaaaacactccttattcattgttgtatataaaaaaacacacccgtcccgcagatagggacgagtgtgtgattaacccgtggttccacccaagttcccgacaaatactatgttgtcggctcggtgctgtaacgcagcatagacggcattggatacttcagttccccaatgctgctccaaggcggtaaatgatattcctaagctgggaagctctcacctttccttccctctctgaaaaccgtaactatcattcgtgtccttttcaacgcatttatgtagttcatataaaaaaacacacccatccctctaaaagggacgaatgtgttgatcatccgtggttccacccaaattcccgacaagcgctatgttgccggctcggtgctgtaacgcagcatgacggtatcggatacttgatttccccgatacggctcaaaggcggtaagctgctttccctgcgttaggaagatctcagctgtccttccctctctggaaaccgtaaaaagcatctcgtgtccttatcagtgcctgttgtttcaataattttttatatcttactatatattcccacaaagcgcaatcagtgatttacatttttttctgacgcggcagtcccgttatgggcagccagaaacagccatacaagcaatgcagcgaggctgtatgccgctcccatcatcaaaaacgtaaacccggcaccagcataccaagtggcggacagatgaatgatcaccccggttatcgctacgccgaccaaggctccgatttgccggtttgcatttaacgccgcaccggcgatattcgtatgtctttgcccggcagcctgcatgatcacagttgtcatggcaggaactgtaataccggtacagaggttcataacagacatcaacaccgccagctgccaataaggaaaatccggagaaatcagcacaaacaacagcaatgcaatgatacagctgaccgccattgatacaaacataagctgaccggcttcaaaccgattcgccagacgggcaaacagcagattgccgatcacgaagaccgccatcatcggcagcagctccactccagccataaaggaacttgcgcctcctgcttcctgtaaaaaaaggctgagcataaacatgccgccaaaaagggcgaaattcagcaaaaacccgataaattgggcagctgagaagcggccgtttttgtataaggacgccggcaggatgggtgcttttgcagaaatttcccgcagtaaaaacagcacaaatgccaaaatcgctgcagtaaatgctacaagaatcactggcgagcgccagcccgctgaaggcccctgtatcaaagcataggaaagaaacccgagagccatcatgccaagcagatgcccgatgatgttcacgcggctgctttttcccggaacgcggctgaggattcggtaagctgaaatgagcgcagcagcccctattggcacattgatcagaaaaatactctgccagcccgccaactctaccagcacgcccccgataaagggcccaaggcctgaagcggcggaaacaagcgcggcccacagcccaaacattctcgcccgcacccgctcatcaggataagaggcagccaaaaggctgagtgagcttggcataaacaaagctgcgccaattccctgtataaggcgtccggcaatcagcatctgcccattaaaggatgcagcgcatagacaagaggcgagaacaaaaacagctaaacccaggatatagatcgtcttcgagccgaaacggtcggccaaggctccgcccgccagcagaagcgacgcaaaagtaagaatgtacccgtccacaacccacgttacacctgaaagtgacattgaaagagtgtttttcatatcagccatcgccacattcacaacggtcacatcaagagttgccatgaggaaaccaagtgcgagcacgatcagcacggatatgcctgttgatgatgttgattcttgtatagacccgctatttttcattacaattgccctttcacttgcttgattacccactcatctattttttcaagatcatacaattccccgactctgtccatgacatgctgcaaggattcttctttcatgagattggaccatttatcctcgatttcccccatgactgtctccagcacacagtgactttcaccctcaaatacagattgcagcaggcctttcccctgatacatcgaacctctgccttcgaccgcttgataaacatcataaagcgtaatgtccgccaaaggcttcgtcagggtaaaaccgcccttcgtccctggtaaggattctgccaaaccggcttgaactaatgttctcatcagcttcttcaagtaagacggagacacgcgcaatcgctggcttatagcctctgacgtcaaagaagcctgtacaggcagccgtgacagtaacagcagcacagaaaccgcctgctccattcctgatttcattttcatcctattcactcctgattcattatggataactattatccataatgaatctcttggcagcttttgtcaataaaaaagcaaaagaaacgattcatttcttttgcttggtatggttaacaaatctgcttcagttcctctatgtattgaagcgcttcgtcatattcttcatttgtatatttttgcttgcttttgatggtaaagactttttctttcttttcctcatcctcaagcccgtcaaagtaaaggatcgtggaaaccagctctaaaaaccgtgatgaacggctgtttacactgtcgatatagcctttcatatccggcatgtccagatcagcatggtctaaaaatgcggagcctgtctcagtcagagaataccggtattgaaagtagccgccctttttttccttcacctcatgcagaaatccaaggttgcacagctcttcaatctggagcgtcagttcctctgaatatggtccgtaaaagtgaaaatcatatttctcatagaaaggaaactgcattttcttggcgatataaatcattttctgcagcttctttcgcccgatgatttctccagaatccgagaacaccttcatcagttttgcatgttctttcaacaaattcccgacatctcctttttccttctttccaatttctatgtcagtcccagcagctgccggattttcattttcgcttccggatgtttagagccgtcacaaatcaagtcctttggatagtacagcttgtggtccgtccgccgtttacctgagatggattccacaatagccgactgcctggacagctctttaatttggccgttttgcgtcaagagatggatcggcagacgctcctcttcctctcccggtcggtaaaaatcgtatggcagatctgatgaagaatcaacgaccaaataatagctcggatcgatccccgcctctttgaacaatgaagtcagctcaaaataagccgacatttcttcattcggattgaattcaacgtattggaaaagctggcggttaatgaatctgcggcacaagtcggataaaatcgcgtcttcttcatcctcccaggcctggaagtaatacaaaataatagattcatccagctttacataatcctccagtgtcaatttcccttcaaaaatagaatagaaatgaaccggagcgtgagtgaagacatagccttcatcgtgtagctgcttcgccctgtgaagaatcttcgttaaaatgacctctgcacttctggtcacaggatggaagtagacctgccagtacatttggtaacggctcatgatatagtcttcgacagcgtgcattccgctttctttaatgacgatctgatcctcgcgcggccgcatcacccgaagaatccgctccatatcaaaatggccgtagctgacgcccgtataatatgcgtcgcgctggaggtaatccatgcggtctgcgtcaatctgactcgaaatcaggctgaccacttgcttgtttttatatgttttggcaatgacttcagcaacatcctgagggaaacccgggctcacctttctgagcacctgattaacctccgtgtctcccaaaatgatacctcttgtaaaatcctcgtggtcaaggtgaaagaccttttcaaatgaatgcgagaacggcccgtgcccgaggtcatgaagcagtgccgcggccaaacagagttcacgctcactgtcatcccattcagggcggcctttaaagacgtcatcaaccattcttctgacaatttcatagacaccgagagaatggttgaaccggctgtgctcagccccatggaacgtcaaataggtcgtgccgagctgcttaattctgcggagacgctgaaattcacgggttccgattaaatcccatatcagcttgtcccgaacatgaacatagcggtgcaccggatctttaaacactttttcttctgataattttccatttggatacgccatcgtcattccctcttttttttagccgtgtttctattatatcgactctattctttgaaaacatccttgaatttgcccggcgatttgttccatcttcatgaaaaacacatcttgtgaagcaaaaaagcctgacctgagggccgaggctaagaaaaaatatgtttttacttttttattttcttttttactttgtcaatcagctcatcctctgtcggagctgacagcgggcgattgttcacaaaagcaaatgattttttccgtccgggcccgcaataagattggcatcctacctcaacctttgcgtccgggtccacttctttcaaacgcggcagcaatgttttgatattagtggcttggcaatcatcacacactcgaaattcattagccatgacgtacgcttcccttcatttctatgttcatctatgtgaataacctaaaatcacgtttcaaaaaaaatcacatcactcttcattttacaaggattcgactgttcctgcaagccgctccatccttcgtatctcctattctttcagctaatttgtataaatattttccaacctggacattctaataccatgaaaagaaaaatgggagttgagataaatgacaaaacagcgacaagacgcttggtcagaggaaaacgatctgcttttagccgaaacagtgcttaggcatgtgagggagggcagcactcagctgaacgcctttgaagaagtcggcgataaattaaaccggacatccgcagcctgcggattcagatggaacgcagtggtccgccatcaatatgaaaaagcgcttcagcttgcgaagaaacaacgaaaacagcggatgagagcgctcggaaacgggcagcccgcgaaaaaaagattattatatcagcctcctgccgttgatcctgaaatcattcaagaaaccgctgcagatgagccggttaaaacggaaacaccttctgtcgaaaatgagcaacctttaatgtctggcgaacatatgccttttgttgatgaaagctttaaggaagagttagctagtctatcacacttattgtctcctcaaacgcctgcagctgcgcctgagatgacgatgaatgatgtgatccgcttcctgcagaattacgaaggcaataacgagcaatcatcagcattaaaaatggaaaatgagcgtttaaagaaagaaaatcaggaattgcaaaacaaaacagagcagctagaggcagaagttcaaaagcttgaaaaagaccaaaaaacgatccaagaagattatgaaaccttggtgaaaattatgaacagagccagaaagctagttttatttgaagaagatgaacatgcctctccgtccttcaaaatggaccggaacggcaatttagaaaaattagcggaatgacatagaaaaatcccaaaacgggcagctgttttgggattttcgccatgtacaaaatccccttttctattgagaaaagagaatttcctcattttgcagccggatcagctattcttgtaaaatgaggccaagcttatgtgaatctattaagacatgtgagctgcctcggccgttttttgtttccgaggcgcagcagaaatgaccaaaagccccagcatcataagtgcaatgcccagccacgaggaaggcgaaagcatttcccctatgaaaaacacgccaagcaatgaagccgtcagcggttcagctaaagacagcgtgaccgccgccgaggccggaaccccggtaagccctttcgcaaacaaaaagtatgcggcacatgttgcaattaacccgatgtaaaggcttgttcccagtcctctaggggtccatatccacgagatatctgactgccataatagcggcgtcagcaagatggcgctgatcataaatacaacggcggaggtcgctcgcggaggctgggttttcatcatcgctttactgatgagcgtatagcctgcaaaagaagcacccgctccaagcgccataagaacaccagccacatcaatccgaacattggaactgtcggaaaacagaagccagcaacccgctaaagccagcacagtcgcaatacaccaggagtttcgcgggcgtttcttcaatacggcccactcaagggtcccggcaatgataggcgcactgccgatggcaatcacagttcccactgcaattcccgtttctttaaccgctgtgaaaaacagcggctggtaacacgccatacaaacagcggctaaaaatacgagcggccatgaccaatttttcacgtgaagctcccggctgacccaaaccgcaagcagcatggcgcttcctcctattaataacctgaacgccccaaatgccagcggtgtggcgctttctggagccaatgcctgaacggttcccgtggtcccccagaaaaaagccgcaatcaatacaaaaaggctgtaaatattccctttcatctgcctctcccctttaatatggatgctgatgtcattttatcgtttttctttttgtcacggttatctgtatgtaagaaggatttatctgaaaataagattattggggtaaaatgccgcttgagataaaaaatgcatgccggcatatacagccggcatgcgaagaacgttcacccaaatacctttgcattccgctcagccatccggacgaggtttttctcaaattccatttcctcatcaatggacagtccggcagagtaaagatgggtgcttaacgcttttaattccgtcaataaagcgaacattaagtcttgtacggagatgtctttttgcagaagctcacttaaggacgccatcgtttccggacgtatttccgggtagacgccttttttatcgttttgtttgtctttcagcgccgcttgatagaatcgtctgatcaagtcggccctttcactgccgcttttatccgcacagagataaatttgaacagcgactccgccgcgaacgcgtctctgagagatgccggcgaactttttgccatttatactgaggtcatagctgccgggacaataagacccttcaatttcataggcttcgatctttgcattgtacggtctcagcattcgtctcatcagctcaaccatcgcttcatatcctttgtctatatcgatgcctttcttttcgtcctcgaatatgagagagatatttaaaacaccgtcatccagtacgacggcaagaccgccggaattgcgtacgatcacacggtatccttcactctccagcaaggagatgccatcctgcaaaaacgggaggcgtgtatcctgtattccaaggacaattgtatcgtggtgcacccatgagcgcgctgtcgccggcgacacgccttttccgacggacatgcacagcgtatcatccattgcgaaggattgcttcgcatcaaataaagggccgagactggattggtcaatgactctccatttcggctgcatcagtaaatcaatcggttggtttgccatctatgtaaaaccctttcatgttaggcttattgaacgaaaactattatatcatttcagcagctgtgattgataattgcttttcagcatcgtaataaaaatttctttattttttgtattctccatgagaggagaatgaatgtaagacagcttgcgctttaacgagaaatctttaatatgcagaattgaaatttcgcggtggatcaaatccttatgcagcacgcttctggatagaaccgaaagtcccatgccgttgatcaccgcttcctttacaccttgattgctgctgatggtgaacattgacttcggccgaagcccatttgaactgagtacatgatcgagatattctctcgtcccggagcctttctctcttgtcacccacgcttcgttctgcaaatcgccgatcgaaatatctttccgcccggccagcggatgctgatttggagcggcaatgcacatttcatcctccatgaacggttcaatttccagctcattctcgtttgtatgtccttcaatcagcccgatatcagcctgaagcatacgcacacgctcgctgacctcctctgtattgccaatcatgacatcgaggttcagctctggatacagcttttgcagctgggccaatagcggcggaagaatatactcaccaattgtaaagcttgcagctattttcaattcgcccttcacatagtgatgatgcgcatagatttcagccttggcttgttcgtagagaaacaccatttgctttgctctttgatataaaatgtctcctgtcggcgttgtcgtaaagtgttttggcgacctgttcagaagagccgtttgaaattctttctcaagatttttgatatgcagactgacgctgggctgggagatcatcagcttttctgccgcttttgtgaagtttttttcttctaccaccgctataaacgttttcagcacgtcgtaatacaaaaaccccacccctgtcattaatgaaatatatggttatgattagttttctttattgtactcatatcatccgtcttggtaaagaaggctatacagaagcgcaaaaaaggcagccctcggtcgagagctgccatcgtcttcatttttattacagtgcttgcgccgctgtaattaatgcgagattgtaaacatcttcagcgttacatcctcttgaaaggtcgtttacaggcatatttaaaccttgcaggattggtcctacagcttcaaagttgcccaaacgctgagcgattttatagccgatgtttcctgcttcaaggcttgggaatatgaatacgttagcgtcccctttgatctcggaatccggcgcttttttctcagctacagatggaacaaatgcagcatcaaattggaattcgccgtcaagtgtcagttcaggcgctttttctttcgcgattttcactgcatccgctactttttctgtttcatcagattttgctgagccttttgtagagaagctgagcattgccacgcgaggctcaatgtcgaacatttttgccgtattggcactttcgatcgcaatctcggcaagatcttggctgtcaggcgcaatgttgatcgcgcaatctgcgaatacgtattgctcttctccgcgagccatgatgaacacgcctgaagtctttttcacgccttcttttgttttgatgatttgaagagccgggcggacagtgtcagctgtcgagtgagcagctccgcttacaagtccgtctgcaaggcctttatacaccagcattgtaccgaagtagttctcgtctaataacgctttgcgagcctgttcttctgtcgctttgcctttgcggcgttctacaaatgcttgtacaaggtcttccatgccttcatatgtatgaggatcataaatcttaacgccgtccagcgtaaggttcaattcttttgcttttgcttggatctcattttcattgccgatcacaatcggattcagcactttgtttcctgcaagcttgctgaccgcttctaaaatacgctcgtctaagccttcaggaaatacaattttaacgtcttttccagctactttttcttgcactgttgaaaataaatctgccacaataaaacctcctcaaaaagttacaaaaacgctttcttttactagcatactcttcttccaatcaaattcaaacagccaactttcattatagcgctttcataaaaaaatcttatttttctaactaatttaagtgactcaatcttcccttataggttcttctattttgatggagttatacggaagggatgttcaaggtttctccacagtagaatcggataaactatggtatagtgaaggcaatcatgaaaagataatgggagtgaagataaatgagtgaacagcaaatgacgaatgaagcggcaaaaacgcttgacggctggtatgcgcttcatgatttccgcacaatggattgggcttcctggaagctgctgtccagtgatgagcgccaatctatcatacatgaattcaccgggttgcttgaaaaatggggcgtagcccaaaaagaaggaaaaggatcgcaaactctttacagcatcgtcggccaaaaagctgattttatgctgatgatccttcgtcctacaatggaagaattaaatcaaattgagcttgaattcaacaaatcaagacttgctgagttcaccattccggcatactcctacgtatcagtggtagagctgagcaactacttggcaagcggtgacggcgatccttatgaaaatccgcatgtgcgcgctcgcctttaccctgaactgccggaatcaaaatatgtatgcttctatccaatggataaaagaagatccggcaatgacaactggtatatgctttcaatggaggaacgcagaaacttgatgagaagccacggtttaatcggccgcagctatgcgggcaaagtcaaacagatcatcaccggctctgtcggctttgacgattacgagtggggcgttacattattcagcgatgatgtccttcaattcaagaagctagtgtacgaaatgcgttttgacgaagtcagcgctcgctatggcgaatttggttcattctttgtcggcaatcacctttcgcttgatacacttcctcaattcctatatgtataatatcccctcccgccctatccggcgggagtttttcaatcctcctttatcagaatttaaataaaatttgctattttcttcgttttttcttacgatgtagataataatccaattttttcaaaggggtgcagttatttgtcaaaacgaaccgcatttgttatgggagccagtcaagggattgggaaagcaatcgctctgaaattagcagaccagcacttttccctcgtcattaattcgcgaagtttggataatattgaatctgtcaaagaagacattttggccaagcatcctgaggcgagcgtcattgtccttgcgggcgatatgtctgaccagcatacgagagcggccatttttcaggaaatcgaatctcaatgcggacggcttgatgttctgattaataatatcccgggaggcgcgcctgatacatttgataactgcaatatagacgatatgacggccacgttcactcaaaagaccgttgcctatattgacgctatcaagcgtgcttcctcactgatgaaacaaaacgagtttggcagaatcatcaacattgtcggaaatctgtggaaagaacccggcgccaacatgttcacaaacagtatgatgaatgccgctttaattaacgccagtaaaaatatttccatccagcttgctcctcacaacattactgtcaactgtctgaatcctggttttatcgctacagaccgttatcatcaatttgtggaaaatgtgatgaaaaagaacagcatatccaaacagaaagcagaggaacagattgcttccgggattccgatgaaacgggtcggatcagccgaagaaaccgcagcgctcgccgcgtttcttgcctctgaggaagcctcctacatcacgggacagcaaatttccgctgatggcggcagcatgaaaagcatataaaaacatcccgctttttagcgggatgtttcttgtaatgacccgaacggcaggttcagcttttgaatccgcatgacaaattccctcagatcctcctgcttcgacaccattgagattctgacatgcctttttccgttgcttccaaaaatttcgcccggtgtgactacgacatgggcatgctccagcaagtaatcggaaaattggtgagatgtctcaaacgtattcggaatttcagcccatacgtaaaaggttccttttggcttttccatcttccagcccaattccttttcgcaaagcgccgtaaaaaagtcaattcgttccttataaattcgtttcaacgattccgtatgctccggatctccagaaagcgccgcactcgctgcctgctgcagcccgccgaacatgccgacaaatacatgatcctgaaattcattgacggcctgaatgatcttttcgttcccaaccgcaaacgccattctccagccggccatgttaaatgtttttgaaaatgaataaagctctgctccgacaattttggcatcctctgcctcaagaaagctggccggtttttgatcgaattcaaacgctccgtatgcaaaatcatgaatcaaatggatgttatgctctttcgcaaaagcagcagctcttgcataaaaagccgcatcagccacagctccagtggggttgttcgggtagtttaaaaacataagcttcgctttttccagcacggctggatcaatcttttcaaaatccggcagatagccattttcttcatacagcggcatttcgtaaagctcagctcgcgccattgtaatccctgataaatattcaggatagcctggattcgggactaaagcgatgtctcccggattgagcaggcattgtgtcagcacatacaaaccggctttcccgcctccgaaaagcgcgacctccgtttcaggattgattgtcacgccgtattctcttttatagaaagcagcgattgcttccttcaaaaaaggatagcctctgaatgggccgtatccatgaaacgaaggattcaaggacgcctcccgcaaagcctccacaatatgcggcggagtgggaaggtcagggttcccctgtccgagattaatgatatgggcccccgttttttccaattcctttaccttttgaaaaacgagagaaaactcctgccttggaagtgtcttgatgacatcggacggtgttatttccatctaaaagactcctttttgctccgttttgttatcccgttccaaaaacgatttgttgacgagcttcgtatgcagaaacaaaccgcatacgatcacgacaatcagccccataatgaccggagcgcttaggatgttaatgaacattgaaccaatagaaatgcataatccgatagacgcttcggccactgaaaaaatgcgcccttgaatctggtttgccgcattttcctgaaccttcacttttgcaagcacttccccgtattccatcgcgatgaaaaagaggatcgccgcgatgacagaaacagcgaaaatcggcgtgaataaaaacagcgccagtgagacaatggataaaacggtaaagtacgtcaggcctctattgttgttaaagccccatttgctgacaagcaccgctccgataaagccgccgaagccgatgcagaacgtgagaataaagttgccgatttccccgtcacccagaaagcggctgacaatcggaaaatagctgtacacaactccccacagcaaagccattgtaatcatcgtaaacatggcgtttaatacgaatgcattggttttgatttccttgagtccttccttaaaagactgaaaggcctctttaatgttttcagattgaatcggcacaaattgcagtttgatacggctgatgaaaaatgccgaaaccaggtatgtcacaccgttaaagacaacagccagctctacagatccgcctaacagaaagagccctccggcagcggccccgacgataatggagatggttgtcgcttttgcaaataacgtgttgatgcttttaatatctgattccaaggacgacatgacagcgagacgggcgggattaaaaaacacgccgcttccataagaaataaacagcagggccagaaaaatcagcggatactcgccttttggaagaaatgtgagccccaaaaagatgatgcctctgatgatatccgtccacagcatgatcttaattctgtctaaccggtcgaccagaacacccaaaaacggctgaaacaccatcggaatgcttctgaccacgatgaccccggacgtcacccaataatcgtgataatatgtagacaaaatgagcagggcagggagaacacaatagtctcccatgaacgatagcgcctgcccgtaaagcaagtatttagagttgggtttcagctgtttcatactggcagcacatactttgccgtcagcttcgcatgctgctgaatttgtctgattgattcagccacatcctgtgaattactgcctttcagttcaaatgcagcaatggaattgaaagcttcaaacaatgtcaaatcaactgaagtgcctggtgctgcggccgaaaaagaaacgatttcagtatccccttttaaaagcccgtccggaatatcgatcgcttcaatgaccaaatcctcagcggtttctggaatctggccattttgtttgaaatgctgcgggtacaaatggcagtcggcgacatagtaaggctcttgatccaataatccgtccggcagatcggcatcttttccgaaacagaggacatctaataataattgcgccatatcaaggccgaaaacctttttaatgttagggatcatattccagccggcaaatctggctgccgattcaattaaacccggttctctgtttttcattagcttgacctctgtatgtgttgcgcaattttgcaggccaagcccttcatttgcctttttggcagcttcgacaattttcttttttgcctcttcatccagaatggacggcgtaatgtgggatgtctctgtaaacccgatttgcggcgttttatcatgaatggcgatcgggaaatactcaccgtcagccatgatgccttctatactgatatagtcggagtacccttctgtttgataccagtctccgtactcaccctgtaaaaattcttcagcgataaacggcgcttcaaacgtaaccgcctttggcacgttaattgatttcagatagtcattgactctgttaaattcatcttctgccgtctcagtgtccgtaatcagcgttacaccgatagaactcgctaagtatgtaggctttaagataagaggtgtgccgatctcttcaagagcagcacggaaatcttcaagagttgtgactcgtttgtttttgatcgatttgactccggccttattaaaagcgtccctcattttatttttatctctggcattttcggctgcctgcacgccggcacctctcaggcccagacgttcacaggctttcgccatcggagcaatgaataattcattgtttgttgtgatggcatccgccccaaacatttcggcaaccttgacgatttgctcgacgacctcttcctcaggcttgttatgatcttcatgcgcccaataaatggaatcagggtgctcaaaatcagctaaactcttaaaatagtctttatcttttatgaccacgaccgagtatttttcaatcaatgctgcatgggaggctgtaattgcaaaaggtcttggaataaagctgaccaggttatatttttcagcagcgcttttataaaacatgtgcggcgggcagcctccaagatcagcgatgaccaatactgtttttctctccatatgtagaacactccttctctattgtgcggtgtatcctccgtctgcggtgatggcgcttccggtcatatagcttgataaatccgaggctaaaaacagcatcacgtttgcgatttcttcaggtttcccaagcctctgcagcggatttaccttcgctttttcttttttaatctcttcaagtgtgccttcattattttcaaggaatgatttttcattcagcggtgtgtcgatgatccccgggcatacgcagttcacccgaatttgatgtttcgcataatcaacggccattgatttagtcagctgcaaaaccccgcctttgctggcgttataagcaggaatatcaggccatgccacgagtccgccgacagagcacgtattaatgatgttgcccttgccggcggccagcatatgcttgagtgcatgtttgctcattaaaaacatgccggtcaaattgacttgcagcaccttgttccaatcgctgagctccatctcgtgaataggcgccacgatttcgatgcctgcattattaatcaagacatcgagcccgccaaatgtatgaaccgccgattcaactgcgtgctggcaggcatcttcgtctgtgatgtccgtttgcacaaagtgcagcctgtcattattttcttttcgtaccattgcttctccctgcgcttcatcaatatccgccacaaccacattggcctgctggcccaaaaaagcctgaaccgcagcataaccaatgcctgatgcgcctcctgttatgaggacggttttatcggtgaggttcatgatcattcatccgccttcattttttttgcttttgctctgttgtagcgcggcgggaagaagatattaatcgattttgattctttttcagaacggttgatggcaccgtgatcttcacgaggctcacagaaataggctgtgccgaatttcatctcgactgtgcagccttcgaccgtcatgtcatagccgccgccgatgcagatgccgatttgttcattccgatgtttatggaaaggcatttctccgccatttccagggattttggcaagcataatttctacccaatcctcaacaaagaacgtaacttccatgcccggcagcaggtctcttgttttgaaaatatccaaaaagtagtcctcaggacttgtatatgtttcatcagctttcagccgcttgatatcaatagcaatcacttcttggtctgtgtcgtttcttgccccgtgaggcacatgcggcggcgcgatataggcagattccaaggctgtcatttttcttgtcacatctccgacagtcatcatcagctcgccagaaacgaccatgccgatttggacctccttatgctgatggggttcaacattggtatgcggcgggacgtaagacattaatacttcagtatcccctcgtacggttgaatactgcctcactccgttttcccattcaattaatttcggtgtcgggaaataaagctcctgcatatcttctttagttttcatcatcaacgtctccttttccaaataatgaccagctcattggaatgcttttgaatgtttttacaaaggttagcccgtacttttgccgtgcaagctcattggttaaggcaatgtcatacaaaccttcttttacttttcttgcggcttgactggttgaattgactagtttgaaacgaacatctttgcgggtaaaatattttattaaattaataggtgaaggatgtgaaacaataacagatgtatcaagcatatcgtctctgaattcaaaatcaggacgaacagccaggccgtacatcggtgtatcgcacctgaagatctgcaatagctgcaaatccggcctcatgtagaaatgcttaatgccatcgtaagcatgtgggacgatggtatattccagcgggctttggagcgtcctttcgatgcatgattcaaaagtatcatgcaaggacaatttactgttcagcccttgtagaagagtaaaattggaaatgaaatgctttgctgcgtactcactgcttgtcccctcagggccgagcgtgttgactgtaatgagtttggatagtgaatcagttcttttttttgtctgaatgctattatccaatataatcatgagcaccaaccaatcttttaaaattttaagtaaattttatccagcggcaattgaactgtcaatgttttttgaaaatattgataattattcccatacaaacaaaaaaaccctttataaagggtttttaattataggaatttagaaactttgtttattgagataaggactgatcggccttctgctcaagtttgccgtactttttatatgcgaatatactgagcacaaatccgaggactgtgatggctgcgcaaatcaatccgacagctgcatagccgtatgccacatagacgggtcccattaaagcagaacctaatgtcacggccagattcgaggcgaggctgtaaaacaccatgacttttccgcgatgacgctctgggcagtcactcaaaatggtgctgagcagcgtcaccgtcaaactttgcattaatccccaaataaataggctggcgattaacagaaatattgacgccggtgcatatggtaaacacgccagcagaacgctgatgacccccagcgcaatcaaaagggagcgcatttttccgatgcggtcggctatctttcctgtaatcacactcatggaaaacccgattccataaatcatgataaataagcccgcagccgtgtttcctccggtaaaaacgtcctgaagataggtgcctaaaaaggaatacataccgtaaaaaccaatcatattacagaaggttatcgtgatataaacaggtacacgagggactttcagcgcatcccggaatgttcctgccggctcttctatttcttccttgccactgtttttatgttgggcatggcggcgcatttcaaggagaatcagcaggacaactaaaacacccatcagggcgaaaatccaaaacgtccatctccaatgcaggacaccgccgataaatgatccgagcggcactccgaaaatcagcgccagcgaccagcttgaaacgatcagtcccatcaccttgccccggtatgtataaggaacacgatcaccgacaactgcgtaagcggtcggaacaaacgctcccgcagccaatcccgaaagcgcccgacctaaaaagaagaaaaaaatattttgagccaaagcgcatatcaccgttcctatgataaagatcataagcccggccaataagctcagttctctggagtatttatcgcctaatggaaccaaaagcggcgcaccgataaaaatcataatgccgtaaatactgatagataacgcaaggacgctgacatctgagttgaaggcttttgctaaatccggcagcagcggtgagatcacaagctcttcagatccggctgcaaatacccccatcgttaaagccagtgccaacaataacggaaaatgatgttttgttttgatgtcattgttttgattgctgttcattctttctcaaacacctcttccataatcttcttatcataaagttgtattatagtttagcattgttttttccttatttacaattcgaacgaaatctttataacttttattattttcatttaaatcacaatatatatttatatatttcattctaaaaacacacagggatgtaacgcgtaaaaaagctctccggcctcccggagagctttttctattgcgcctctgtctgctttttttcaatcggttcatgatttatacgctttttgatgctcagatgatagtatgcatagcagaaaataatgatcggcacaccgcagtacaagccgattctttgatccggaatgaaaataaggctgatcaacacgcagccatataaacaaaatccgagaatcgggactagcggataaaacggcgttctgaactctagatcattcacatttccgccttcagcaaggaaacgtctgcgaaagaaaaattgcgacgcacaaatggacatccacgcgacaactgtcaccatgcccgagattgagatacaccataaatacactgtttctgcggccatgacactcgtcagcagcgaacagcctgaaatgcctagcgtaatcagcagggcattcatcggcacgcctttttttgtcagtctggtgagaaaggatggacccatttgatttgatgaaagtgaccacatcatacgcgacgccgcatacaaccccgaattagcaacagataaaatggctgttaagatgacaaagttcatgatatctgccgaaaatgggatgccgatttgatcgagtaccgctacaaatgggctttcaatcacccccgccgttttgtacggaaggatggcaaccaagacgaacatagcgagcacaaagaaaaacagcgtgcgccaaatgacatttcgaatggactttggcagtgttttttccgggctttcactttcccctgccgcaatgccgacaagctccgttccctggaacgagaagttcaccatgaccagcgtaaacataacggccagcaccccattagggaaaagtcctctatcagtcataaagttagacaaaaagggtgtctcctgtccgcctttaaagtcaatcaagccaaacacagcggctccgccaatcacaataaataatatgatcgccgccactttgatgcttgaaaaccaaaattccatttctgcaaagcttctgacagagagcgcattaatcaaaaagatgacgatgccgaacacgaggcaccatatccagatcggaacggagggcagccacctttgcatcaaaatgcctgctgacgtcagctctaaccccactgtattcgcccagctgaaccaatacagccagccaatcataaagcctgtcgacggtcccagaaatttagtggcgtaggcctgaaacgatccggccaccggcatggcaacagccaattctcctaaacaaagcatgacgagatacattaaaaatccgccgatgatataagcggcaatggcgccgagcggtcccgcctggctaatggtaaagccagagcctagaaacagcccagtgccaatcacccctcccaaagcaatcataaacaaatgcctgcttttcatgctgcgctgcaattcatttttatgattctgcatcatccttccccctttggttcttttgccgtgatggtcatccggtagctttgcaaaagatgaacggtggtttgctgtatgaggagaggcaatacatgaaatgtgtacggtttatagactcgttctgtccatttatggccgtcttttccgtacacgcccatattaatggatggaatattcagcttgcgtatgtctttgaacggaatggtcccaatcatattccacccagggaagttcctgataaaagaatcaatttcgccatcggtttcgtgcagtgataaaaaactgccgtctgccaagtaggggaaaaactttttgaagacaaatgtttcgcctgtcgattcagcggttttgtcagccgcttctttaatcacatgctgcaaaagctgatctcttgcgctatcttctttcaaatagttatgtggcaggtaaggaggtgcgtaaaatagaatgacttttgcgccttgatcggggtcaagcttttgaagctcttcgattgcctgaaagcatctcatgcgaagttcaaggtgctcgttggctttgaatgtctgctcgatacactgctcgggatctatcccccggtttctcagcttttctaaatattgctccaggctatacacttgaatgtcccatgataaatgtttctttggcaggttggctctttttgcatattcttcataataatctgataatttttgttctgtctcccggcatgcttcctcagtgacttcaataagcaaatccatcatttcttttgctgttctttcataaataaaacaattgaaatacaaactggtgctgacagccgtttgcacattataggattccttgttatcacgctgatacaaacaggatggtggcagaaccaactccccttcaaccttttctgccagatggatgttattgtggagacggcttgtgatttcagatgaaatgaaatttgggtcaatccctgccagtgtatcgccaacatggacttcacgcccgtaaatgtaaaagcaaggcagcagttttcccgcggctccggtatagatatatcttgtctgatcaccatcgtaaagcggggtaataaaatccgtattaatagcagccaaatagtgaagctgtttttctttttttaaccggttcagctctgaaatgctggcgagaatgcccgaatgctggctctcctcatcgggattggccataaacaatacatttcccggcaatgtctcaaggttctccgaaaaatgcaggagattggctaaatgcacggcgatgccgctttgcatatcaacagatcctcttccgaacatccactcgcctgatttggcatcccgctgaacatcctgatcgaactcatagcggctgaaatactcggccaatttctcacaatcaaaagcgatatcctttaaagggccgaaatcttcaattccaactgtatccagatgggcatggtaaatgactgtatttcggctttctccatgtcctttaataaacgcaaaaatatttttgcgattgtatgggtcattgggaatggcctgttcccacacatgactggggttttcctgaaaataaggatagctcgtgatcacttctttgatgaaatctgcttttgtcccttctccaacggtgccgttcacgctgctgaggctgaccagagatgctgtcagcgcctccactctttcagccggattcatgtgactgatttttgtatactgcataaattgtcctcctgatcaaaaagttgaaatcgtgcgatccgctaaagaatcgcacgattttatttctctcaaatcaaaaagcttcggacgttgttttggcttgcatatgaagaattaagtaatcgggaccgcctgcttttgagtctgttcctgacatattaaaaccgccgaacggctgatagccgacaattgctccggtacatcccctgttaaaatataggtttccgacatggaaatcctcgcgcgcccgttcaatgtgcgcacggtttttcgtcagaagcgcgcctgttaatccgtattccgtgttattggcaatctccagcatatgatcgaaatcacgcgctttgcaaatcgcaacaaccgggccgaaaatttcttcctgcatcaagcgggcgttttcatcaacatctgcaaagatcgtcggctgaataaagtagccttttgaatcatcgccttctccgccggccaatagcttgccttcagatttgccgatttcaatgtatttcatcactttgttgtaggatgcttcatgaatcacgggacccatatacgtatcaggatcttctggattgccgacagtcagcgttttggtcagcgccacagctttttccaccacatcatcatacacatcctgatggatgaccgcgcgggagcccgcagaacacttctgtcctgaatatccaaatgctgagtacacgatagaggatgcagcaaggtcaagatcagcgtccttgtcgacaagcactgtgtcttttccgcccatctcagcaattacccgtttgagccatttttggcccggcttcactttggcggctcgctcataaatccggcagccgactgcacgggaacctgtaaatgagacaaaccgtgttttcggatgctcaactaagaagtcaccgatctccgctccatctcccggaatgtaattcagaacgccgtttggcagacccgcttcctccatgacctcgacaaattttgctgccactaccggggctgcgtcagccggttttaagagaatcgtatttcctgtcacaatcgctgccgccgctgttcccgccataatcgcgagcgggaagttaaatggagaaatgacgatgccgacaccaagcgcttcgtaatgatattgattgaactcgccagcacggctcttcaccggagccccttccttgagctttaacatttggcgcgcgtagaactctaaaaagtctatcgcttcagccgtgtccgcatcggcttccttccacggttttcccgcttccttcacaagatagcttgaaaattcatgctttcttctgcgcaaaatagccgctgccttaaagagaatattcgcgcggtgctccggtctttgttttttccaggaatcaaatgcctgcaatgcggcttgcatcgctttttcagcaagcacttgatccgctgtagacgcgtacccaatgatctcttctttatttgccgggttaatggaaatgattttgcggtccgtttcaattttttctccatttatgacaagcggataatgcttgccgagctgagtgtttacaaaggccaatgactccccaaatgcagttttattctttgcttccgtaaaatcggtaaatggttcgtgcgcgtatgtgactgtcatatgtagtccccctcgtgttatgaaatatatcttcgcatatgaataaaaatgcaagaatcatgccattttcttgtcttttgctgaaaaaacttgttgaatcgaacagaaatttgtctaacaggtgatcacctttctctttttccgatcttgaacgcaaatttattttgcgatttttgctctttacgcaaaaaacaaatgcaaaattattttgcggaggcttctcaaattagacccatccgcggaatcgcgatgcttctgccgattttctgatgcccgtcatgtaagccgccaaacgcatatccactttatgtgttgccgctgtctgataaattgtttcgaacgagctgaccatgacgtttctcagtttttctgcaacctcttcttctgaccaataatatccttggttgttttgcacccattcaaaataagaaaccgtgacgccgccggcactcgccaggatatccggcacaagcagcacgcctctttcattcaggatcttagtggcatcaatggttgtcggtccgttcgccgcttcaacgacgattgacgcctgaatgttatgtgcgtttttggctgtgatttgattggagatcgcggcaggcactaaaatatcgcaatccttttcaagcagctcctcatttgtgatgacgtcagtaaataaattggtgaccataccgaagctgtcccgtttatcgagcaaataagggatatcaaggccgtccggattgtagagcccgccattggcatcagaaatcccaatcaccttcgcgcccgcatcgtgcatgaatttggccaggaagctacccgcgtttccaaagccctgtatgatgatgcgcgcgttttgcagcttgatcccttttttcttcaccgcctcttcaatacaaatcgtgacgccctgtgcagtcgccgtttcccgtccttgcgatcctcccaaaacaagcggtttacctgtaataaagcccggagaatcgaattcccgcagccggctgtactcatccatcatccacgccataatctgcgaattggtgtacacatcgggagctggaatatcctttgtcggaccgacgatctggctgatggcacggacataccccctgctcagcctttccagttctccaaatgacattgtccgcggatcacaaataataccgcccttcccgccgccgtaaggaagattggcaatcccgcatttgagcgtcatccaaatggataatgcctttacttcctcttcattaacttctggatggaagcgaacgcccccctttgtcggaccgacagcatcattgtgctgtgaccggtagcctgtgaacactttgacgctcccattgtccattttgaccggaatgcggacagtgagcattctctgcggctctttcatgagttcatacatatctcccggataacccagcttccgaagggcttccttaatgattgtttgggtagacagaaataagttaagagcttctttttcttcatctttcgagacttgctttgctgacatcttttttcacctcattgtttttttggccggctgtaatgtaagcgctttaaaaaatcagcccgccaattcctttctgcattggattcacccctatcatcatgcaagatccgtaccagcttttgaatccacaaaaaaagagactgaaaacatctcagtctctgactacaaatctatcgattaacggggatcaatcaccagctgcgtttcagcataaaaactgccgattcccaaaccgtttactacatcgcctttaatcgtgtaagtgcctgcgcgaggaagagttttacgcaccatgacaaggtcaaattcggatgcgcctaacaaatcaagcgtaagcgggagtctgactgtttttccatcgtttaaaatctgtgtttctttcagtgttcttccattcactgaatctcttgtcgtagcatgaaacccgtcaggaaattgaaattctaccgctccaagagaaagcaccgcatttggtttatatgtcacttcaatatcagaagtggtccactctttcgtgctgttaattgtttttgcctcgattgatgcagactgtgcatgagcttggcccgaaggaagtaagattgatagtaaaacagctgaactgatgaataatgaagatacgaatgaagttctttttagcatgacatttccccctaaatgattgttgaaatttggccagagcgtcctctgcagaaaaagcgctttttcataattcgcgaattaccagttctttttcttaaaaattaatctatcatcattttacatggaagtaaatgttttttaaggaatattaacacttggaattcaatgagaattccttcctgtttatacaaggttcaaatggacgatttccctctctttttctagtaacatccgcctgacattttatatcttttatcctattttaaaaaagggcaaaaaaagtcgaagatgcctctgctcttcgattgatcacgttcctatttttatctgaattcagtgttccagttaaaaccgatcgtctcatcattccacggaattcttttctcatcaggctgatctgggttatacgacatggtggtaaaatagataattgtcagcggcgtctctcccagcactctatatccgtgagccaccccttttgggattaataacagcatcggattgtcttcgcccatataatagacgtccgtttctccttttgtctttgaatcctctcgaagatcgtataggacaacctgagcgtggccggttgggaagaaccagagatcatcctgcttctcatgataatgaaatgccttaatcacacccggatagcttttcgaccaagaggcctgcccaaaatgctcaaggagattctcatcgtcccggaccagctcagcaaaaaagcctctgtcatcgctatgcttcatcaattttttcaccttgactccatcaatcacacgcactgctcctttcctgcaaatactctcgtaacgcttcccgccagtggcgggggcggatgccggcttcttcaatagcccgatggctcagcacagagtatgccgggcggggcgttttgttcccgtattcctctgtcgttacaggcaaaatggctgtttccagcccgctttcttccataattgccgtcgcaaactcataccagctgcatatgcctgaattgctgacatgatagatgcccggcggatggctgaacagcttgatgaccgcttctgctaaatccttcgtataagtcggcgaaccaatttgatcgctgacaacccgaagctcttgtttcgtttcagcaagcttcagcatggtttcaacgaaattactgccgccatgtccgtacacccacgatgttctgatgatcgtgctgtcttttgtcgttaatcgtatcagttcttctccgagccttttgcttttgccataaatggtttttggatcgaggggatcgtcttccctatatggctgggttcctttcccattgaatacatagtccgtgctgatatgaacatattgagctccgatgcgggttgactcaagcgctgtataataagcgccgattccgttaatcaagtacgctttatcaagctctttctcgcattgatcaaccgacgtaaacgcggcgctattgaccacgatatccggctgataatggccaaacgaatgccgtactgagcgctggtcagcaatgttcatcatcttctttgttaacgcaatgacctcatatccggcttgcttcagctggcggcatagttccaagccaagctgtcctcccgccccagttaccaatacctttgtcaatcagatcaccttctcatcggtcattgtctgtataccactgaatcgtacgcgcaatgccttcttcaaacgtcacttcctgccgccagcccagttcatttttcagctttgatgcattgatcgcatagcgccggtcatgcccttttcggtcttccacgtgggcgaacaattcctcacagcccagatgtttcaaaatgacactcgccagctctttattcgtgcgttcatttccgccgccgatgttatacacctcgccgtcgtttcctttttctaaaatcagtttgattgcgcggcaatgatcctccgcaaacagccagtctcggatctggagtccatcgccatacagcggaacaggtaggccctgcttcgcatgacggataatcgtcggaatcattttttcgctgtgctgataaggtccgtaattgttgctgcatcgtgtaatgatggccggaagcttgtgggttttcacataagacaacacgagcaaatctgagcttgctttgctggctgagtatgggttattaggagaaagcggcgtcgtttctgtaaacgcgggatcatccgcttttaaatccccgtacacctcatctgttgaaatatgaatcagcttcttggcttttcctttcaagaccgcttccgccaatcggtatgtccccatgacatttgtggtgataaacggctccgcttgggaaatgcttctgtccacatgcgattctgctgcgaagtgaatgacgccgtcgtaggtctcgtcaaacgcccggtcgatatcctcctgaacgctgatgtccccttttacaaagcgaaaacggctgttttgctgtaatttttccatttcctccgggtggctggcgtacgtcagtttatctaaaacggtaatgcgcgcatccgtttccctcagcatgagctttgtaaacgtgagcccgatgaagccggccccgcctgtaattaaatatgattttgccatcacttttcgtcctgtcctttccgtagagcctggtgtacaagctgggaagcgagataaagcgattcgtgagttccggcatctacccaccagcctgataacacatcatacgtaagctggctgttttcgatgtatagattattcacatcggtgatttccagctcgccgcgctttgatggtgatatttgttcaatatatgaaaacacctctgcatcatacatataaatgccggtaacacaaaggttggtcggtggctgttcgggcttttcgatgatggaacgaatccgcttgtttttctcatcaatctcagcaatcccgaaacgttccgggtcatcaacttctttcagaagcacttttgctcctttcccctgctgttcaaagcgttctgtataaggctttaatgaatcttcaaatatattatcacctaataataaaatgaaagactcttttttcgtaaagcgctttgcataagacagcccatccgaaatgcccgatgctgccggctgtacttgataagtgatagtaacgccaagctcttccccgttcccaagcagtttgtaaaattgcggcatatgctccttttggctgatgagtaaaatgtcttttattccggcttcctccagcttcataatcgaccagtatatcatcggatacgggcctacaggaagcaaatgcttgttgacggctttcgttaagggcataaggcgtgagccgtttcctccggctaaaataacacctttcacattaacacttccttacatgcatttttatatctcttgttcatataaatcttgaagaatagctgttacccgtataatgcctttgccatccacgagcggccttcctcccttgtgcaaagaaaggcgaagaggatagctgctcataatgcgtgacatctgatagatgagtgtttcatccggtacaagctcacccaatccaagatcaagagcggcgccttggtcagcaaatgttttggctgtagccgtttgatgctcaacctgagaaagaacaaggcacggcacgccgatgcaaatggcttcatatagagagatgccgccggcgacaatggctgcgtccgcttgtttcatcaaacctgccatatcatttgtctgttcgatcatcttgtactgcggcttcttttcgatccgccttcggactgcctcttgatgcggtgaagcgctccccattacaaacatcatgtttttgtcttttatgtcggggacttgatcagcggcagccagcactttaaaaataagctgcttcggatcacttcctcctaatgcaacaaggatattgcggcagtctttcttaagtgtgtaatcctctcttgcggcctgaaaggcggggtgaagaataagatagtccggaccttcatagatgcgtgtgtttccctgaacgtacaccctgcttctgatgtgaccgtaaattccgttaatgactgcgtcactatattgaatcgatttaccgtttttctcttcaaaaagaacaattttcgcatctgtctccgtctttattttctttaacagctctgcaggcgcgcctagaatatcaaacaaaagcaaatcaagcttcttgctttttatttcccggagaataaattcgtgctgctgcagctccggctttacgatgacacgccaatgctcttcatgaagaaacgcttcagactcctgattcgtataaaacgtaatcaagcatcgctgtttgagcccctccgcaagtctcttcatccggacaacatggcccattcccttttcatagccgccgtctgcgaagatcccaacacgcatggctattcagcctctcgttcgattgccgcatcgggattccggttcagaagggtgataagctctgaggcggatacatcggggcgctcgcctgctttttgatagagggcctttattgattcatagtcttcctttgtatcaatggtcagccgatatcgaggggcgcgaaatcgttccggcgcctctaaaaactgcacacgataaagagctggatgattccttatatataacgtgacatgctcctgatattgatcctccatattctgaatacggctgatgtcaattaacaggttggcgttgaccacttcgccgcaaatccctaatggggcattcaggatatacgtataatccgatccttgatcaaaatgcgccttaatcattacatcgagcagctccggatcgacaaacggattatcacccgttaaccggataatgactgacggtttaacagcttctatgaccttcacaaacctatcgaggacacgttcttcgctcccgcggaaaacacgaaagccttgtttgatacagtgcgcctctaatatgtcgtcagtttctttgtcagacgtggcgatgacaagattatcctgatccttttggtaaaacgcgctttgccggacacggtgaacgagaatgtcaagtaaacgattcgatccgagcggccgaagcacttttcccggaagccttgttgaacccattcttgcctgaatgataaagagaatatcattcatgaaacgggctgtccttcagtaaaatgtcatcccagacaatgcctgtgtcggccggaatgtctcttacagcccgaacaccgctggtcagcagttcaaaaaatctcgggtgcagcccctgcggcttttgtccgggccgaagcactgcgatattgtcttcactaaaggcttcacctttttgaatcggagctgttgtaaaaatgcctctgtatgcaaagtttctgatttctccttcgatggaggttgttgttttgtatgaactgccaagcagtttttcagagaccggctttgtgatcccctgtttcagctcagcttccgttttcctgatgccatcgaccatttctttcaattcatccggatttaatgcaaacgagtgatcggcacccggcaaatttttatcgatcgtaaaatgcttttctatcagttttgctccgagccgaaccgcggcacacggcgcttctgtcggatgctcgctatgatcggagaagccgattaccgcctcaggaaaagcggcggcaagcatcggaatgacgctgaggttgctgtactccggcggtgcagggtatttcgccacacaatgcattatggcaatttgattgtttccctctgccctgatggtgcgccaagcttcgtgaacatcagagatttcagctccggctgtcgagaaaatcatcggcctgttcagccgggcgacatatttgagcagcgggagatggttaatttcataggatgcgattttaaaagcgctcggcgaggtagactgaagcagatcagctgacccctcgtcacataccgtacttaaaaagatcacctgcttttcgcggcagtaatccaatagcggtaaaatccactcagcaggcatttccatagattgaaccaaagaaaaaatagagacgtccttgcccgctgccgtcttgtacaaaccaggatctttctggtacatcctatcagcttggaacatttgaaatttcacggcatccgctcccgcttccgccgcggcgtctatcagcgcaaaagcctgatcaagcttcccgtcatgattaatccccgcctcagcaataataaaaacaggagcgtctttgcctacagttttattcgcgatctgaaacgctgccattatttcgcctccttgcccggccaaatatgataatagtaatacgattgttcagcggtgaagcccattcgttcataaaggcggatcgcccttacattgtgaagctgcgtccccgctgttaccgttctatgcttctgggtctccggttgttctatgagattcgccaataaatgaaacgcaatacgttttccttcaaatcccggctttacagccatcaaatcgagaatgcactcatcatctcttgataagccctgaagatagccgatgacctcgccattgtgtttagcgacaatattgaccgccgcccttccattcagattgtttcgtgtccactcctgaaatattttgtttgctgcatcgcggctgagatgaggatcctgaaaatatctgctttttgtaaacgagtctcgggccagctcacatatcgcttctgtgtccccgggctcaggcgggcccagttcaaaaaatggcggtgttttgtcataaaaagacggaggcattgccagcttcagcaaactcccgacaaagtaagaggatggctgctgctgtatcacatgcgcggctccgatatcttcagccggaacgcggacaaagataaaatccgtttcatccatttggcgtacagtataaaaagcttcaaacagcctctttagctgcccggtactatttgccgcaagaagtttgacgttcatgactttcttctgaagcaccttgctttcccacaaagaatcttcgtaaagcaatacgccttggagcctgctgttttcaaaaaggccgagggaaaattgatacggaacatccagtgtaagctgtcggctttggagaaattcctcaatcaactctttggagacattttcttttaccgtatacacttaatcagccccttttacgatatcccgcacagcttcaatgacatcatctacatcgtcgtcagacattgacggatagagcgggagagaaagggttcgtttatagtaattcatggcattcggaaagtccgcttccttatatccaaattgcttttgataatatggatgaatgtgtactggaataaaatgaacgctagtgccgatattgtattcatcctttaaagccgtaatcatttcgctgcgcgtaaccccggcctttttgtcatcaacttgcagaacatatagatgccaggcgtgcctgccgtcatcatggacaaacggcgtgatcagcccaggaatctgctgaaaagcggtttgatagcggccggcaatctcttctctccgtttctgcatatcatccagccgtttcagctgatgaagtccgagggccgcctgcaaatcaaacatattcatcttatagccgggcgattcgacttcatagtaccagctgccatttgaagaataacggttccatgcggctttactcatgccgtgaaggcttagcacccggatcttatcggcaagctcctcatcatcagtcgtcagcatgccgccttcccctgtcgcgaggtttttggtggcgtaaaagctgaatgctgttgcatccccgatagaaccaatcattctttgcttataagtcgtatataccgcatgtgccgcatcctccagcacgaataaaccatgattttgggcaatagccaatattgcatccatatcgcaggactgcccgccaaagtggacgggcacaactgctttcgttcgcggtgtgacggccgcctcaagctttaccgggtcaatattgagcgtgttttcgtcaatatccgcaaacacaggcgtcgctcccgtatgaataatcgtattggcggtcgagctgaacgtaagcggagaggtaatgacctcgtccccgggcccgatcccttttgctttcaaagccaaaaataaagctgcggtacatgaattcaccgccacggcgtgcttcgccccgacaaacgcggcaaactctttttcaaactgctgaaccttcgggcctttagagagccatcccgattcaagcgtttctgtaacctcctgaatttcttccttaccgattaacggcaatgagtaagggagaaaatgatttctcttttgcaccatttctttgcgctcctatcattttattcagtatcttcccgcctgtaatcaacccctgttttggctttcagttccgcaaataaagcatttgttgattctgccaccggataattagccgctatgaatgccaggcgcgcctcttctgctttttgatgcacgtcgggacttcgaagaacttcaaccaaggtgtgcgccagttcatccggctggtcaaacataaaatcgccaagagactcataatacggatacgagcgatttccggacgattttccgatcagcacaggcttttgaaacagcatggcttcaagaccgactgtcgaggtttgcgtcactgcggcatcagcatacggcagcaaatcataaagctccagctcctttttgatgactctgcatgcttgatgttttttcgccgcctcgtgatacagatcaagcttgttttttccgatttcccacgggtggggtttgataatgatttgcagctgcttctgatcagaaagcccctgcagcacaccggaataaaagtcttctgaaaagggctgagtggcaatgagcacaatttttttagtcggctgaaaagcaagttttcgatagaatatggacatatccataggcgttctgttaaaaatctgatcgaaccggggatgtcccgttacgagaatctgctcgggtttacagccttttcgtatgaaccactctgcttcatacgcaccaaaaacagcttgataggttgtaaaaacaggaatgaaggcttcatctcccatcaatgcgccatgctgaagacaaatgctgacggccccttttctttgacacatgagagcgagcaccctgctgtaaatgtcttctgccgttccgacaataacagctgaaatcttttcctgttcaaacagcgcatcaactgtatcaatggcctctataaataaaggaatatctttgaaaagccggtcgcgaaacgcttgatcaccaaatgccgggtgatcatcataaggggcgagaagcgaacaggctgtttcgagatactgcttcgaatcgcctttttggcatgaatccgctatctcccgcttgctaattacaggcagatcacaataatgcggcaaactccatctggccaaaacagccgttttttcaggatcaaattgatagtaatttccgtttgaaaaacgcaggtaatcaaagtgcaaaatgactttccctttaacaggtttgtcatttgttttaacgattttttggattctttcttcaaaaaacggctgaatctgtccctcatcgatatgctgatccaccgatccgaataattccggttcttcttccatcatcaccctcagctcagggctgatgtattgataaaaattactgataagcccaagcggaatccctttgtagcgaagtttgtcaaaaagctccacgtacttccggtacagcacccaataattgcttaaataggccgacaagctctcaccccattccaagcttttttaatgattcacgcagctctcggcaatttcgctgcggaggaaggttcctgacaaattcatttttttctgattcaaacagctgaaagtgaatcgattggtcggtaatataattcaggtccagctcctcatccagtgggtaaaacggataaaaatgattgactctccaaaagaaccgggcatctcctatacggtaaaacgccgggctttcatcccaataggagccaaacttctcctttaccttctcaagcaccgaatacctgtgcatcaccgagcaatgatcaattgcgcacggtgcgttccatgtcacttgagcggcaggcctgacagtttcttttacaatgtcgcgattctcgtttaaatgataggttttggaggctgagtaaatcacagccttttcaggatgggtatcgagctcccgcaccattttcaggaggcggtccggcatatagatgttgtcatccgtcgcataggtgatatattcaccctccgccatcccaatcgcctgattgatcagtgccgcgtatctcgttttttctgttctttgcttcactccagatacatcgctttgataaaaacgcactcggttatcattcaaaaaaggacggattacattcagcgtctcttcattggagttgtcatccataataaacaattcaaaatctgaaaacgtttgtgagagtatgctagaaatggactttgccacataatcgcttttgttatagctcgtcataatgactgatactttaggcaaatcctacacctccttcttggaacttcacacctgaaactatcgttatcttatgttgcttatgctcaagttgcgctagggatacaaaccaatatgcgaaaagtttgtgtatgtctctgaaaaacagcggctgcccagagcgaaatctgatcggtccgctgttctttttcagcataatccaagcatcagcctcataaggtgaaagagataaaaatcgcaccagcgactaagatcgttttccatcggaggtgagtcatcgcggagcgttcacctatacatccagaacatgttttgaatggttttcataaaaaggaggaacgatatgaaaccgaaaaaaaatcaatatcagcaaatgcaggcatttgataatatgcaggggtatcagcctcagtttggcgccaacccgtacccgcagcaaggccaaggctcacaaatgcagacaatggggatgcagccaatgatgccaatgcagcagggacagcaaggacaacaaggacagcagggatttggattcccgggccagcagcagggcggcggttttcaaattccatcggggcctacaccgtcaggaccgggccaaagcgttcccggcatgctgcctgttgaggaatcttacatcgagaatattttgcgcctgaatcggggaaaaacggccaccatttatatgacatttgaaaacagcaaggaatggggctcgaagatttttcgcggcgtcatcgaagctgcgggccgggatcacattattatcagcgacccgaaatcaggaacacgctacctgctcctgacaatctacctcgattacattacatttgatgaagaaattgcttatacgtatccatattccatggcgtcctattcgccaagataagaaaaaagccaatcactcatatgatgaggattggcttttttgtttatagatatttgacggctgcgacaacgatcataatccaagaaataataaacgccacaccgccgagcggggtgatcgctccaagaatggagatttgcgtcacacttagaatatataagcttccggaaaacagaacaattcccgcaaacatcagccagccggctgtcgtgacactgcctatgccggataatttatcagccagaaacgcgacaacgaaaagcccaagggcgtgatacatatgatactgcacgcctgtgtgccaaacctgaagatatttatcaggtattttcccttctaatccgtgagcgccgaatgctccgagtcccacagcaagcaaggcgttaatagcccctaatatgataaaaactttcatctatctctcccgccttttcgttaaactcatatcatttatcttatcgcacctgcaccaaaattcaatgtttgttctccgttgacacgagattgtcggattttctcctgcgccaaagctggaactggtcagctgctattgcagcaagcgtccctaatacgagcccgttgcttaatagagaaataaataccggatgcaatccctttaacgcagtttcaggaacaaacatgataccgacccctgtcaaaagtgagataccgatgatagacctcaccctttttgattcttttttctcatacgaatcaaattcggcaaaggccagaccgcccattgcggagaacacaacaaaattcaccgcaaatccaacgggtgacggcaggctcgcaaacgtattaataaaaaacgggatcacgctgattacgataaccagaatactgccgagcataaacggttttttagaaggcatcttggtcgtttcaataaaacctgcggctcccgaaatcggaacaggcgcaatagctcccgtcaaaccgctaagcagatggctgaatgaagctgcaaaaccggcatggcgttcatgatgctttccatcaggctgtttgctgaattttttcacggcgatgtccacgaccttcatgctcgccagcatattcacgatcagcaagatggtaataaaaatagaagtgatgatcaggccgctgttaaataacggggtcccaaaaggaaacagggaaggcagctgaaacagccggtccggcatttcaatcggctttgcggctccggcagccgcaaacagcacccacccgccgaacaaggctaataaaatagaatattgcttaaaaaacatgatgttcgaatttgtcattataaaagcggcagcgatcacaacaagcgccaggccaaatacaagaccgtccaccccgtcctgtcgataaccgattccgagaattccttttataatgggctgactcagctgcatgacaagaagcaataaatagacgcccgttacaaccggagtaaacaattttgcaagtctgtcaatgaccttgaaaacacttaacaaaaagaaacatacagcgcttacaagaagagctccctgcaaaccccgcagtgtgtctccatatgtcgcaaacacagttcccgtcagccctgcgtaaatcgtatacactccccaccacaagccggctgggctttcattaatcggcagtctgtggcctttcaaacactgaatgacggcggcaattcccagtacaaaaaaagtgctttgaatcaatcttgcagaatctgagtgatccagatgaaacgactgggcaaccgccaccggaacaacaatcgccgcagcaataataaacgctgtccattgcagcgcgccaagaaccaatttcacgtaagctcaacctctctctttaaaaatcaaataaagactctccgtttccatcctcttcctgcttctctttttcttgctttcgaaatttgtttaatcccgcgctccccatcattttttccatcatcagctggtctgtcgatggcggcgcggcaggacttggcgtaacgctcggctgtatgcggggcgcgctcacgttctccggctgatcaagcacgacatcacacagagaacggacaaccgctacataacgcttcagctcctcatcccgttcagctgtttttgcttttttcagctcctcttccatcttttgaattaatgcagatatatgaatgttcatgaagcaccctccaaaaaaataaatgttgtcttcctgcattttatcaaattcctgctgtaaacgcagatatgagtttgttattttttctgacaaaccttgcgcgattgacaagcagaagagatttttcacataataaatcaccataccttacaaaaaggagaaacggaatgaacagcatcccctctatcatcagcaagcataaagcctattttgcggcgggacatacgagaccgcttgaatcgagactgaacattttgcgaaagctgaaacaagccgtcagaactcatgaagccgatctcatagccgctctctaccaggatctccacaaatccgagcaagaagcatactcaacagaaatcggaatcgtcttggaggaaatcagctttgtcatgaaacggctgaaaaaatggtccaagccgaaacgagtcaaaacgccgctgactcatctaggctccaaaagcatcatcatttctgagccgtatggaaccgttttggtgattgcgccttggaattatcccttgcagctggcgctttttccgttgattggagccattgcggcggggaacacggtcgttctcaagccatcagaatatacgccggctgtttccgctgcactttcgaaactcatcagcagcgtttttccgaccgattatgtcgctatggcagaaggcgggcccgacgtcagcacagcattattacagcagccctttgactacattttctttacaggcagcgtagccgtgggaaaaatcgtcatggaggccgccgccaaacaattaattcccgtaaccttggagctcggcggcaaaagtccctgcatcgtccataaagatgctgacattcagcttgccgccaaacgcatcgtcttcgggaaatttacaaatgcgggacaaacctgcatcgcaccggattatttatttgtccacgaggacatcaaaacgaagctcacagaagaaatgaagcgtgcgatcagagaattttacggccctcagccggaacggaatccgcagtacggcaaaatcgtcagtgaacggcactatcagcggctgctcagctttctgaatgacggcatcccactcacaggcggacaatctgatcccaatcatcacaaaattgcgccgaccattctcgaacaagtgagagatgactctccagtgatgcaggaggaaattttcgggccgattcttccgctctttacataccgcaatatcggggaagtcattgaaaaagtccaatcgcgccctaagccgctcgccctgtatctcttcaccacaaaccaagaaattgagcgcgctgttttaggaaatctgtcgtttggcgggggctgtgtcaatgatacgttaatgcatgttgcgacgccgtatttgccattcggcggcgtcggggaaagcggcatcggcagctatcacgggtttgacagttttaacacattcacgcacaaaaaaagcgtagtcaaacaaacgaaccgcttcgacttcgcatttcgttatccttcctccaaaaacgggctgcgaatgattcgaaaaatactcaaataaaaaagcgcagatcacctgcgctttttacaaatccttaatacaccaatcaatcggcgcctctcccattttctccaaataggcattcgcccgggaaaacggtctgctcccgaaaaatccgtttctcgcagaaaacgggctgggatgcgtcgattcaatgataaaatgcttggacgtgtcgatccgttcttttttcatttgggcatgccgtccccacaaaataaaaataaccggccgctccctttcattcagcacgtcgataatccggtctgtcagtcgctcccagcctttccccttatgggaattcgcctgtccgcgccttactgtcagcacagtattcagcaaaagaacgccttgctttgcccagctcactagcgatccgtgatttgggatgctgcacccgatgtcctgctgcagctcaagaaagatattttttaacgaaggcggatgctttacaccgggcttgacagagaagcttaaaccttgagcctgtcccggcccgtgatacggatcttgacccaaaatgacgaccttgacatcatcatatgatgtataatgcagcgcgttgaaaatatcccggctgtccggataaatcgtttgctccgcgtattccctcttcagcatctctctgagctcttgataatacggtttctcaaactcttcctttagctgattccaccagctgtcttgtaaaagctgtttcaagattcaggcctccttacgaacgatgaagtctggaatagacaggctcgccatcccaaaccatttcactttttgcttcccgcctcttcatctcaggctcttcaagcaggacggcaaagtttttcgtcggcagctccccgagtccgtgcttttcacttaaacgatccaaatattgcttccgcttggcgccaaggtccgcagactgattgtctcccacgtcactgaaggcataaatcacactggcgcaagggacacgcttcacccggtaatccttggctgcgcgcagataaaaatcccaatcccagtaattgtgcacatcagcatcgaaatacccgatttcatcatgcagaaaacgtctgtacatgctgcccgacggcacgtatgtagaaaacactctcatatcctcatagtcagcggtataagcaaacaatttccgtgacactggataccttgttccgtttttctcttcaaacgaaactatttccgcatcagaatgaacgaagtctgccgtttctatttcctttgccattttctcgatatgccctggcgtaaagaaatcatcgtcatcacacagcataatgcaatccccagacgcctcttttacaccggcatttctcgcagccacatgccccgagttcttttctaaattgatgacagcaatcggtagctccggatacagtgctttgaccggcacgaccgattccccggcatcattcacaataataatttcatacggcttcaaggtctggcgggaaatcgactccaaaagctcacacaaagccggaatccgattataggtcacaattacgatagaaatcttcatgatgctctccttctcattttcatagtcatgtactattaaaacatatattggacgggagatcagtgggaatatcctactgaaacggcatactacaatgatagaaacagcaaagtggctccgatcagaagcaccatgatcagcatcagatctccaaagacatgaaagatatctttcatgcggacgccattcggaaggataagacgccacagcttagattgatagaccggcagcagcaccagtgcataagaaagacacaaaaatgtaaaagccggcggcacaaaagcacagcctgcatcgtcccaattcatcatgatgtctttcatactagatccatccaataaaaacaaagatatcatgagggctagcaacacaaaggaccccaattgaacctcaaacaggcgcattttctggttatatgcaaatcggaccgcccaaaaccagacataagcatatgaacatagcagcgtaagaatggcacctgctgtaaagacgacatcaggcagccgatcaagcagaaaaacaaaaggcaagctggctgccatagccaagagcatgcagccaccagtaaacaaaaatactgccccatgagctacaaaaccatataaacaagagctaatcctcacgacatacacctcctttacatagaaattctatgtatatacctaaaaaatcagacaagctgacgcctgccaatataacagcccattcggccaaataacggaaataacagggttgcaaaagcacaagttccaacaaaccaaggtgtcaacaaggattgaaacagcgcagcaggaattacattgaatagaaaaacaagcataaaaatgacgtttggcaccattgagatcagaatcgtatgtagaacaagcttttctccgcgttttccaaactccttcacgccttgatacccaatcagcccccagtagatcatatatgcagctaagatcagccaaacagaaacagaaatgcctttccatactgcttgaacaaacggtgattcaagccatacatgcattattgtaatcgcaatgccgacagcgaatagggcactgttacagaaaagatggaacatcaaaaacgcacggaacgttactggctgtattttcttaaacgaagaaacaatgtcagttggtgttccaaacgcctgcaataaagtctgcatagcttcctcctcactctttccttcctgaaaagagcgaaacagatgatgttcaatatggctctcaatctcttctatcatcgcctcaccctcaggaagccctttaagcccgcttttgatttcggatacatatgtttctttatccattttgtccgctccacttcagtattcggtccatcatggctgaaaatacgctccattccttcgtgcgttccgccagcacttctttgccctcgtctgtaatccggtaatatttgcggtccggtcctttctcctgcttctcccagtaggaagaaatatacccttggcgttcaagcttgtgaagagaaggatacaaggtcccttctttcatctgcagttcatttccgctgcggcttcccatttcttttacaagctcatagccgtacatcggccgctcgttcagaagcgtcaataccaatataaccgtgcttcccttaaccagctcacgatttaacatctcaaaacccctacctagttttcttatgtagcattttacgaaagcccgttgagattgtcaaatgattcctatagatcttctatattgtgatacagagaaaatctaactataatgaaagacaaaacatgatggaggttcaagacatgtctatgcataaagcactcaccattgccggctcagattccagcggcggtgctgggattcaagctgatttaaaaacatttcaagaaaaaaacgtatacgggatgaccgccttaacggtgatcgttgcgatggacccaaacaacagctgggaccatcaggtattcccgatcgatactgatacaatccgcgcccagcttgcaacaattacggacggcatcggcgtggacgccatgaaaacaggaatgctgccaaccgttgacattatcgagcttgcggcaaaaacgatcaaagaaaaacaattaaaaaatgtggtaattgacccggttatggtttgcaaaggtgctaatgaagtcctttatccggagcacgcccaagccctgcgtgagcaattggctccgctagccactgtcattacgcccaacttgtttgaagccagccagctcagcggcatggatgaactaaaaacagttgacgatatgatcgaagccgcgaaaaaaattcacgcactcggcgctcaatatgtcgtcattacaggcggaggcaaactcaaacatgagaaagccgttgatgttctctatgacggagaaacagcagaagtccttgaaagcgaaatgatcgatacgccttatacacatggcgcaggctgtacattctcagcagccgtgacagcggagctcgccaaaggtgcggaagtcaaagaagccatttacgcagcgaaagaattcatcacagcggctattaaagaatccttcccgctaaaccagtatgttggtcctacgaagcattctgcactgcgcctgaatcaacaatcataaacaaaaggggctgccttacagagaggcagccctttttaaatcaccgaagacttttcacagaaaaaactgccgatcccatcggcagcctgtttatttgatttttaaattgtttgcagatttcctcaaaaatgtttctatcgactgaacaaaaagtgcatattccttcatttgttcatatgcccgcgtgagaatttccgccgtttcactgtgcggcgttgttccgccaagcatttttttcagctgaagcagcacatccttatattcttctcgcttatcttcaacttggttagcagccttttccaaacattccggtgttatcttctgttcatgtatattcaagaaaacaactccttttacagaaaaaaatagtaggttatcgttgaagaatagcacagatggctcagatttcacataagaaaatagaaggattttctacataagtgtccaaattccgacattcatttcagatttcccggtcgaactggctgttacttcatgatttcccgggaaaggaaaatatctcgcactaaagacctcttctccgttattgataaagatttccacagatgacgcgtcgagaaacatgtgtacggtatgcaaatccttgatgtggcaatgtctcgcttctgttctttttccgtcaaagctctttcgttccagcgtaacaatcccctcgtctttttggaaggaaaacgtagccgttccgcggatactgattgaaaagccagactccgtatgaatgtcttccagcagaatctcagctctttcagggttttccactggaagcgtaccagatgatccatgcatattgatgtgtatttttttctcatttctgcgcatggcttttagctcaggcagcggctgctgaatcagcttctggcctgaaagcatcagctgtctcggcagcgtcatgcagtgaatccagtgatagtcaatcgtcggatgggatccttcatcctggtcaggcaccgccatccatgcaaacaaaatccgccttccctgatcgtcttcaagtgtttgcggcgcgtaaaaatcaaaaccttgatcaagctccgtaaattcaccatgcttcagttcaggcttgttataatcgagacggccgacaaaataacctgattgatatacgttctgataacggaaaccgtcagcctcaagcccttgaggcgaaacaatcagcacgtccgatccttgaagggaaaacaaatcagggcattcccacatgtatccaaaatcgtccagcccgttgaagcccgcgccggttatcgggccaagaaatctccactcactcaggttatcagaagcaaacaatacagcctgccctttcaaattctctgtttgcgcaccaatcaccatataccatgtgccttcatgctcccataccttcggatcgcgaaaatgcgccgtatatccttccggaaggcgggcgacaacaccctttttctcaaaggacagcccgtcgtcagaaacagcaaggcattgatacgtttcccgatttccatcctgatccctgacatttcctgtgtaaaacagatagagccgatcgtctttcgtgacagcgctgcccgagtagcagccgtttttatcaaaccaatcactcggagccagcgcaatctcttcccgcttccaattcacaacatcctgtgtcgtataatgcccccaaaattttgcgccgtgccccgtctgaaacggctgccactgaaagaatacatgatagctgcccttccaataaatcacgccattcgggtcattcagcagcccaaccggcggcatgatgtgaaaatgctggcggtgcggatcgctgttagcgatgggctcttttttctccacttcttcataagcccggcgacgaagctcctggtcatgtgctgtcattttttcctctcctcatcctcattaatcttcatgacaaatgctgcaatgaacgctgacactgccgcaatcgccatgccaatcagatagttgatcaagttgcccatgccaaacggcgcagcaatggcgatcatcggaattcccgttaacccgtaagcgtttgcagctacatgtgtaaagacgacatatgctccacccaatgcgcctccgatcatcgcggcgataaacggttttcggtagcgcagattgactccgaagatgacgggctcagtaatgccgagaaaagcggaaaatgctgccggaagcgcgatttcttttgtctttgcctttttcgccataaagaagacggcaagacctgccccgccctgtgcgacattcgccattgaccagatcggcagcaagtagtttttgcctatatctgcaataagccccgcctcaatcgcatggaagctgtgatgaacacctgtcagcacgatgagtgaatacgtgcccccgaaaatcaaacctgccacaaaaccggcatggtcatatacataagttaaagcaaccgtaatgccggagccaagcgctctgcccagagggccaatcgcgataaaagcaacaaacccggtgacaatcacagtaacaaaaggtgtaacaagcaagtctaccgcatgcggaaccacttttcttgtccatttctctaccttgctcattacataaaccgccagcagaacagggatgacagttccctgatagccgagaagcgcgatatcaaatccgaaaagatgcatataatcaggtgtcgcttccgccaatccccatggatttaaaagagacggatgaatcatgattcccccgatgaccgctcccaagtatggattgctgccaaactcttttgaagcgctgaccccgattagaatcggcaagaaaatgaatgctgcacttgaaaacatatcaagcagctgaaaaactgcagaatccttgctcatccaatgaaacgcattgatcatacccagcaatcccattaacaggccgctggccacaatagccgggataattgggacaaaaatattagaaagcgttttcgcaaatctcgcagcgggattcagcttttcttttgccgcatcctgatgattgacgtgttcctcacgctcaatatcagcttctttagaaaaagcatcgaatactttattcacaaggcctgttccgaaaatgatctggtactggccagagctgctgaaagcccctttaacgccatcaagctcttctacttgtgcttgatctatctttgattcatctttcatcactaaacgcagtcttgttgcacaatgagccgcgctgataatattttctttccctccgagaagctcaatgaggcgttttgcagtctctttgtaatccatctatttctcccccttttatttaaacaaaaaagacctaaaattcgccaacgaataaaggacacagcgatcctttttcatttacgcaaattttaggtcttgcctgctttaccagtcacaatcccgcttattcagattaagaatacgctttcatcataaatcatgacagcgttttcgtcaactatttttttagttaaatagtttgataaaacatgtagacaaaaattcgtaaaaattaattgtgaaatacttcacaatatcgtgctatactatgctcaatcatgaaagaaagcaggaaaagacaatggaaactcaagcattgcaaaaggttgaacagtatgctttgaaaaaacaaaacatattcgcttcaagcaaaatccgttatgtgcttcggtccattttggccagtatgtttattggttttggcattacagccgcaagcaaaacaggcagctatttctttatggctgattctccgtttgcctttccggcagccgctgtcactttcggggccgctattctgctgattgcttacggaggcggagatttatttaccggcaacaccttttatttcacctataccgcgctccggaaaaaactcagctggcgcaacaccctgtacttgtggatgtcaagctatgccggcaatttaatcggcgccattctgtttgccatcctgatcagcgcgacgggactttttgaggagccttctgttcattcctttttgattcatttggcagagcacaaaatggagccgccggcttccgaattgtttttcagaggaatgctgtgcaattggcttgtgtgcctcgcctttttcattccaatgtctctcaaaggggaaggagcaaagctttttaccatgatgctattcgttttctgcttctttatttccggctttgaacacagcattgccaatatgtgcacattcgccatctcgcttttgatcgagcaccctgatacagtgacactgatgggagcagtcagaaacttaattcccgttacgctcggcaatctgaccgcgggaatagtcatgatgggctggatgtactacacactgaatcctgatcaataaaaaaacttccagagatcactccctgcaagtcaaatcggttattccgagagatcttgaagacgctggacatgcagcgtgatatagccggcctcggattccggcaaatgtaattgatattcatttttcaaaaactccgccagctccagcgcacattgataggcgaatgaatactttttttggatgaaataaagcatctcctcgtccatacgatggagcgcttcatttgattccaaccggctgaccgcgtatcgcaaatgcgtgacaaggcgttgataggaaatgctgttttcatccacctttcgattaaagtattgttctattttctctatcatttctttgatcatggtcgtatgcttcagcgctgaatacatgctctccgcatccatcttcgccgtatggatgtgaagggcaatataacccgcttcatcttcaggcagagacacgcctaatgtctcttttacatgtccgatcgcccacaagccgatctcgtattcttttttatagagcgcctttatctcatgcagcaatttattctgcacaagcaacccattttgaatcctttcgatcgcaaaggacaaatggtcggaaagcgcgatatgaatgtgatcgctcagcggcgccgcgagctctccttccgcatagctgatgatatcctcagctatttctatatgctcctccggcagtgtttgcaggatttgtttgaacttttcattctcgtcgcgcacgacaaagattttttccactttattcatagggatgagatcatttttctttttttgaaaagcgattcccggccccatcacgattttttcctgatcatcctcttttattaaagccgcattgttgtttaatactttatagattttcaagaggttatctctcccgccaatttgcttttgactgggattttacctccttttgaccgccatgtaaagatgcgggcccgctctctcctgctttggcgattccttgaaggcttgcaaacatcttcttttataaagcgcggcggctttcgctttctgcttttcttcctcattcacagccatccgccactcataaaacgaaacgagtcctgcggcctgcacagccgcctttctttggtatgtacgctgagccgaatagaccgcggcagccgcagtttttctgtccggcgtcacccagttcatcaaaaagaccatccacacccgtaaagatacaagcaaacgtttcatagaaaaacatccctccgcttctttttggcaggcagcctttttagcagcccgttttctcagccgcagcccgcaagaaaagacggccgatttcttttctcgcaaactagcggctctagcaaaactcatgactctatgatagaccgtggaaagagaattctttgtcacaatatgagtgaaaaaaccaactagtttttagaagttttgttgaaagctgaaagaattgaaatgaaaattggagaaccgctttgaaaactttatacacaagttatcccaaagataagaacaacttaatcacaagagatatccacatgtccacaaactctatctatattttgtatacgaacgtatattcctaactatatatatacacaggtttattcacttatacacagggttctgtgtataactccttcgttatacacaaacaaactccaataaatggtccaaatgacacaaggatttttttgaattttcaagaaatatatactagatctttcacattttttctaaatacaaagggggaaacacattgaaaaaggggatcattcgctttctgcttgtaagtttcgtcttattttttgcgttatccacaggtattacgggcgtccaggcagctccggcttcttcaaaaacgtcggctgatctggaaaaagccgaggtattcggtgatatcgacatgacgacaagcaaaaaaacaaccgttatagtggaattaaaagaaaaatccttggcagaagcgaaggaagcgggagaaagccaatcgaaaagcaagctgaaaaccgctcgcaccaaagcaaaaaataaagcaatcaaagcggtgaaaaacggaaaagtaaaccgggaatatgagcaggtattctcaggcttctctatgaagcttccagctaatgagattccaaaacttctcgcggtaaaagacgttaaggcggtgtacccgaacgtcacatataaaacagacaatatgaaggataaagacgtcacaatctccgaagacgccgtatctccgcaaatggatgacagtgcgccttatatcggagcaaacgatgcatgggatttaggctacacaggaaaaggcattaaggtggcgattattgacactggggttgaatacaatcacccagatctgaagaaaaactttggacaatataaaggatacgattttgtggacaatgattacgatccaaaagaaacaccaaccggcgatccgaggggcgaggcaactgaccatggcacacacgtagccggaactgtggctgcaaacggaacaattaaaggcgtagcgcctgatgccacacttcttgcttatcgtgtgttagggcctggcggaagcggcacaacggaaaacgtcatcgccggtgtggaacgtgcagtgcaggacggggcagatgtgatgaacctgtctctcggaaactctttaaacaacccggactgggcgacaagcacagcgcttgactgggccatgtcagaaggcgttgtcgctgttacctcaaacggcaacagcggaccgaacggctggacagtcggatcgccgggcacatcaagagaagcgatttctgtcggtgcgactcagctgccgctcaatgaatacgccgtcacattcggctcctactcttcagcaaaagtgatgggctataacaaggaggacgaagtcaaagcgctcaataacaaagaagttgagcttgtcgaagcgggaatcggcgaagcaaaggattttgaagggaaagacctgacaggcaaagtcgccgttgtcaaacgaggcagcattgcatttgtggataaagcggataacgctaaaaaagccggtgcaatcggcatggttgtgtataacaacctctctggagaaattgaagccaatgtgccaggcatgtctgtcccaacgattaagctctcattagaagacggcgaaaaactcgtcagcgccctgaaagctggtgagacaaaaacaacattcaagttgacggtctcaaaagcgctcggtgaacaagtggctgatttctcatcacgcggccctgttatggatacgtggatgattaagcctgatatttccgcgccaggggtcaatatcgtgagcacgatcccaacacacgatcctgaccatccatacggctacggatcaaaacaaggaacaagcatggcatcgcctcatattgccggagcggttgccgttattaaacaagccaagccaaagtggagcgttgaacagattaaaaccgccatcatgaataccgctgtcactttaaaggatagcgatggggaagtatatccgcataacgctcaaggcgcaggcagcgcaagaatcatgaacgcaatcaaagcagattcgctcgtctcacctggaagctattcatacggcacgttcttgaaggaaaacggaaacgaaacgaaaaaagaaacgtttacgattgaaaatcaatcttccattagaaaatcatacacactggaatactcatttaatggcagcggcatctccacatccggcacaagccgtgttgtgattccggcacatcaaaccgggaaagccactgcaaaagtaaaggtcaatacgaagaaaacaaaagctggcacctatgaaggaacggttatcgtcagagaaggcggaaaaacagtcgctaaggtacctacattgctgattgtgaaagagcccgattatccgagagtcacatctgtctctgtcagcgaagggactgtacaaggtacctatcaaattgaaacctaccttcctgcgggagcggaagagctggcgttcctcgtctatgacagcaaccttgatttcgcaggccaagccggcatttataaaaaccaagataaaggttaccagtactttgactgggacggcacgattaatggcggaaccaaacttccggccggagagtattacttgctcgcatatgccgcgaacaaaggcaagtcaagccaggttttgaccgaagaacctttcactgttgaataagaaaaagccctgccgaatcggcagggctttttaaagatcagtcagcaaacgcctcctgcaataatcgatacgatcggagcttatcttcaaaatgatgtgtgatggtcaccaccatgatttcctctgtttcatacgctttactcaaagctagcagccgctccttaacctgttctttcgtaccgacaatcattcgatttcgattatcagcaattcgtctctgttcataaggagaatacgtatttttccgaacagcttcatacgaaggaactccctctaaaggaataccctgctctcccgccaaaagtgtaaaatcaagcacagccccaagctcctctgccttctcctccgtgtcagcacaaagaacaaaaacagcaactgccgctcgaggcgtatctcctaacacagatggtttgaatctcctcttatactgtctgacagtaccctctccgccctctccattgataaaatgggcaaacatatagccagcgccagattcagctgcgagcagcgcgctttctccagatgagccgagcagccacacatccggagccgttgaaatatgcggcgcagcggtcagattcggaaaacggtgtttatcatccgccaaatcatgcaaatacatggtcagctccttgatttgctgcggatactgatcagcattgcgcttaccgccgtcattcagcgcccatgatgcaattggcattccccccggtgctctgccaagccccaggtcaattcttcctggtgtcagcccctccagaacacgaaagttttcagctactttataagcactgtaatgcggcagcatgactcctcctgatccaacacggattcgctttgttttcgctgctatatgactgattagcacctcaggactggaccctgccagccgttttgaaaagtgatgctcagaaacccaaaatctcttatatccaaggtcctcagcagcttgggcaagcgcaacggtttgctgtaaggccgtttctgcattgctgccctctgatactggagattgatctaatatacttaatgaaaccatccctaccacctcatcctcatcgtatcactgatcccctattttttctccaaagccgctcacactgcttatcagtgtcccctatcattcgccatttatttgtgaaagcctgtccctatttgtcggaatatgttacacgtgaaacataaaaacccctccagacggagaggtttgctttagtttttattaaagcccttttctttcacgtagtcatttaaatacgtacgcggcttttgcttcataaagttcagtatttgatcggaccacgtttcttcccgttgcccgtttgttctttctctatagtaatcagaaatggttttgtcatacgtattcatagtatgacggaaatcgtctgtgttcacattatacgtattctcatgataaacggcctgctttggcaatctcggttttttgccggaaaggttcgcaggatggcctactgccagtccgaaaagcgggagcacatggtcaggcgtttgcagcacctctgtcaccttgtccagttcattccgaatgccgccgatatagcaaatgccaagccccatggattcagcggcaatgctcatattttgcgctgccagcgccgcatcaatcaagctaaccataaacatttctgtattctcgagcagctcagaaatatgttcacctttttcctcagccagtttttgatggcggtacaaatccgcacaaaatacaaaaaagtgtccgttcttctcaacgtaaggctgattcccagcaagcacggacagctcacgttttttctcaggatcagaaaccccgataatcgaatatgcctgcacatagctggatgtagacgcagcctgcgcacttttcactaatgtatcaatttcttcagctgtcaaaagctgatcagtaaaagaccggattgaccgatgattcaaaatggtttcgattgtgttattcatcacaaaaacctccttatcactttttatcatatccgaaaaaaagtgatctcaaaagcgaaatgctctgcacaaaaaaagacagcctctgtaaaggctgtctgcatattaagaattaaaaagataacttctgtatttcgtcagctgcacacttgcattatatacaatcccaaatccgattaacgtggaaagtgtcgagcttcccccatagctgacaaacagtagcggaatcccggtaacaggcataatgccgatgttcattccgatattctggaatgtgtggatcacaattaacgccgtatagccaacgcaaaagaaagaagcgaaacggttaaacggatgtattttgtctatcagaacaacaagcctgtagattaaaaagaagaacatgatgacaacaattgcacagcctataaagccaaatgactcacctattatagaaaagataaagtcagtcgtactctctggaacataaaccttcaaattagaaataccattacctaaaataccaccagatcctattgccatgatggcctggtcaacttgccagctgtcatttgaatcttcctgtgtctcatttgaagcagacacccaagaagtgacccgcttaatttgataatcctgtattccaactgatttagcaacgtcaggaaagtttatcattactaataaaattaatgaaatgagtaagatacctgaaccagctatgatcgcaatcaatttccaatttatacctgacataaaaaccattacaagaacgataaacatacatattcccgcagtcccagcatcctgcatcaggataagacctacaggaataactgcgacacccgcaatctttaataacaagtggatatcatccctaagcgtccgaactcctttaggattagcttttccaataactgaagcaagcatcataatcaaaccaaccttcataaactctgacggctgtattgttattctaccgatcctaaaccaactttttgcccctttaataacaggtgcaatagactcgggactgattttaagaataatcaaagataaaataccaatgataaaaatatataaacttaacttttcaagctgttctaaatcaaagtacaaaagaactgtaatggcaacagcccccaaaaaataaaacacaatttgctgaatccaatccgtgttcccatactgcccaaactgaccggcagcataaattgatactacgcttataataaaaaacacaccaaatataaaaatcaaatccccctggtaaaaggggctttgctgtttcttatatcgactcattctatcccgccttacattttcatcggaaaatcactaatgtttattatacatgaaccacgttcaagatgacacgtgaagctcgcttccttttatgttttttcagcatttgcggtgctttttcagctacacgaaatatgacgtatcataaaccgaaatgtttcgattgacacaaaacttttcaaatgaaaaaaacgccataccaaaagaatttgttaaaaaacgaatgcgataatgtgttatgttcccaaataatgtgatacctcataagaaacagctaaaaattcagagccccatgcccatacattctcctagcacattaaacgaaaaaataagacgatagatccagtccatttctgcaaaaacacgtatcaatttctggaaaacatggtataataattgtaacagaatgttcaaaaaacaatcacaaaacagacacaactcagttcctctatttcatttttgtaaacgttatcacaaaatgaaaggagacgggtatgatggacatgttttttgcttacttattggttgccagcgcaacgcctctctttatttggcttgataacaaaaaagtcgcactctcagctattccgccaatcatcttaatgtgggtattcttcttcttttacgcaacagaaagcctttctccacttggacacactctcatgattatcttgtttgccgtcaacgtcatagtcgctcatatcgccgcatttatcatttacggccttccgtatcttcgcagaaagcgaagcagctgaagacagcaaaaaaccctcttccaatgaagagggttttttgtattattcgttatggcctgaatgctctgagtgttcagcgcctccaggaggatttccgtccatatggtcaccatggtgatagtgagccgcgaaaatccagatggatccaagtacgataacgatcgcgccaaagaatccgaacagcgtgtttccaacttggatcgtgccgttttcgctctctgtcatatgcatgaacatgagaagctgcagcgccgcctgaatgaaggcgaagccgaagattatccaaagttttgctgatgagctcaggtcagtatacactgcaacccatagagccagcagggtcaaaacgatagacaggataaaacctacaatgtgtttccatggaaagtgactgtgttcagcagatttgtttgccattttacagaccccccaatcccatgagatagacacctgtaaagatgaaaatccatacaacatctaagaagtgccagtacaagcttgagataaagattttagatgaagtttgcggggttaagccgcgtttcttcaactgaatcagaattcctgtgatccagaaaatcccgattgttacgtgagttccgtgagttccaagtaaaacaaagaatccagaccagaacgcacttgtactgagagccgctccttcatgtacatagtgaacaaactcgttgatctcgcatccgacgaagccggcaccgagaagaagagtgataattgtccaaatgactacgccttttaaacttccgcggcgcatttcatgaacagcgatcccgcaggtaaagctgctgatcagcagcaagaacgtcataatcattaccagattgacttcaaatagttcgtctggcaagacacctccagctgttctgtttttaagaacgaagaaggttgcaaatagtgttgagaacaacacaatttctgcccctaaaaagatccaaaacccgagaatattaagtctgccggtttcagattgatattccataggcgcgttagaattgccgtgttctgcatgttccataactcacgcctccttattcggaaatctttctttccgtctcttttatttcatcaacactaatgtagtagccgttgtcgtattcgaatgaacgcagaaccatgcagagcaggactccgatcaatccgactacgcccatccagtaccattcaaataccagtccaaagccagcgagaccgaaggcaacagacataaagaacggtctgcctgagttgcttggcatatggattttcttgaatttgctttcagggtataattcagttttttcttctttcatatgcaggaatgcatcttgagatttgacttcaggaagcaccgcaaagttgtaatgcggcggaatcgcagaagaagtcgcccaatcaagcgtacgtcccacaccccatgaatctccgctgatttcacgagtagagtaacggaagctgtagtagatgttatagcaaaggattaagaatcctacacccatcatgaaagctccgacagttgagataaagttcaatgttgtccagccgtcgttcggtccgtatgtgtaaatacggcgaggcatgccttgaagccccaagaaatattgcgggaagaaacaaatattgaacccgatcataaagatccagaagaaccattttccgattctttcgttcagcttgtggccgaacatttttggataccagaaaataaatccggcgaaacaagcaaatacagtacccgcgatcagcacatagtggaagtgagatacaaggaagtacgtattatggtattgataatccgctgctgccatcgcaagcataacccctgtaaccccgccgataacaaagttaggaatgaacgcaagcgcccacagcataggtgttgtaaagctgattcggcctttatacattgtaaagagccagttaaagattttaaccccggttgggattgagattgccattgtcgtaattgagaagaatgagttaacggacgcactgttccccattgtgaagaagtggtgagtccaaactaagaaactcaatacagagatggcgataatagaaccaaccatcgctttgtaaccaaacaattgttttcttgcaaagcttgagatgatttctgagaaaataccaaacgccggaagaataacgatatatacttcaggatgtccccaaatccagaacaagttagcccaaagcatcggcataccgcctgcttccaatgtgaaaaagtgagcgccgaacaaacgatcaaatgataaaagtgctaatgctactgtaagtacagggaacgcaaacacgataataaccattgtgatcagtgttgtccatgtgaacattggcatacgcattaaagtcatgccttttgttctcatttttaagattgttaccataaagttgatccctgtcatcagggtaccgataccggcaatctgaagtccgaggaggtagtagttctcacccggcccagggctcatgtcgttacttgcaagcggcatataactcgtccagcctgcgttcggagaacctccgataacgaaagaaatattgaaaagcatcgcccctacaaagaacgtccagaagctcaggttgttcaagtaagggaacgcaacgtcgcgggcaccgatttgaagaggcacaacaacgttgataagaccgattaagaacggcatcgccatgaagatgatcatgattgtaccgtgagttgtaaaaatttcattatagtggtttgagtctaaaaaactgttattcggaagcgctagctgggcacgcatcatcagaccgtcgacaccgccgcggaataacataattacagcagatataatgtacatgattccgagttttttatggtcaacagtagttatccattcagaccacagccatttccactttttgaagtaagtcagtacaaaaataatggcaatggttgaaagcgcaatggaaacttgtgcgcccagaattaatgggtcaccagttacgaaaaattcgtcccatttgaatttcatgcaggcttcctcctttcctgatcaatatcattcttctgtatcatcagacttcttaaattcgtttttctttacgttttcaaacggatctgttttagagtgcggtgaaacggcttgatagccaaggcgtttgcgcgcctccatcgcgtactcagcgtcttgtccgtgatcaacgtatttcaagtgagtagaagagaacgttaattcgtccacattttcaggaagcatcaattcatcatacttctcttttgtcagcttaggagcctcgttctgagtctttttcacccagctgttaaagtctttttctgtaactgcattcacatcaaactcttggtctgcaaaatgttcacctgtgaagttcgcgttgcggccttcgtaagtacccactttgtcagcctgtaagtattgatccatcagcattcctgccatcgcatatttttgccctccaagctgaggaatccatagcgaagccattgaatctgcagatgagattttgaacaagatcgggcggtcgacaggaatgtttaagtagttgaccgtttcaatatcctgttcagggtagctaaatacccatttccagtctaccgaagtagcataaacaacaagaggctctttgtcttttgttgcttcaggagctttttctaacgaatatatcgtctgtactgttggcacagaaagtgcaatgacgattaaaattgggatcactgtccagactacttctaaaaacgtgttaccgtgaatttctgggttataagatccattatctttgcctttacggtcgcggtattttactaaaataatggtaaatagaacaaagacgaccccgacgataaacagcataaatccgatagataacaggattaaatcactttgctgttcagctacaggtcctttcggatctagtactgaagcattgctgcatcccccaaggacgaaaaccacagttaacagcgctaatacaagcaacggttttaatgctctgaacaagaagatcaccatccttcctattgatgtaataaatctgaagtgcatacttcctcaaaatcttttctctactttgttatgctatcaaaaacttcacttattagctttatttttttataaacttcatcccattttcgcttaaatgtcataaaatcgacaaaaattgctccaactttattcacatctatcgcttaagatgaaaagtttctagttatttccgcatataaagtaaagaaagatgatgaagaactaattctgacaaattaaggtttaccacaataaaaaacttaggtcaatcaaaaatttcattttgttaaactttctagataggaattattttttccttgtctagcatcttttcacacggttaccattttaacgcatcaaatattgaaagaaaaggcgcaatgaagagccaatatgctctgaattgtccgtatttttttatgagagcatccagttgtttatcttatacaaaaaagaggaatgatataagcaaataaataaaaaataggatgtgttgcatgatgagttttcttatttcacttatcgtcgctattattatcggatggcttggaagcctgtttgtaaaaggagatatgcccggaggaattatcgggtctatgatcgcaggtcttattggcgcctggatcggacacgggctgcttggaacatgggggccgcacctagccggatttgccattattccagcggtaatcggcgcagccattgttgtctttctagtaagcctgttaaccagaaaaagaggataaaagcagcagcacccgaagcgtcagcgctttgggtgtttgttttgccataataatcgaaaaagcctcaaccctagcggttgaggcttttgactggtttgacgcccaactgatcgatgaaccttctgaaggcctgttttccctctgctgtctgcttaaacacaccggcgtgttcaaggatgcgcgcgaatacatgtcccagctctttttttatgactagatctgcattctcttttgttatggttcttttttccatcattcgaagagcccattcactatgctttgccgtgagcggattttgttctaaggctgttttcggatcagcagagcatagcgccgctgccgtttctttcatttcctcctgtaagcggcccggcaatatcgccaatcccatgacctcaatcaggccgatattttcttttttaatatggtgaacttccttatggggatgaaatattcctaatggatgctcctcatccgtccggttgttcctcagtacgatatcgagttcgtacaattctcccctgcgccgcgcaatcggtgtgaccgtattatggggcgtatcgcctgtataggcggcaatgccggctttttcatcggaatacgtctgccacgtgcggaagatatggtcagcagcttcggcgacatgacccggttcgtctccttggagcctgagcacagacatcggccacttcactaagcccagcgacacgccgggataatcatttaattcataaacgtcttccgcttctgcacgtgccattggaaaatcatgcgcgccgccttggaaatgatcatggcttaggatgctgccgccgacaatcggcagatccgcgtttgaaccgataaaataatgcggatattggccaagaaatgacagcagcctttcaaatgtttttttgctgatctccatcggttcatgttcaccttttaagacaatgcagtgctccggataatagacatatggcgagaattgcaggaaccattgttcgtcctcaaggatgaccggaatgattctgtgattttgccgggctggatgattcacgcttccctcgaagccgacattttctttacacagcaaacacatcggataatttgtctgttcctgctcttttgcagccgcaatcgctttcgggtccttttcaggctttgataggttaatggtcatttccagctcgccatattcggtcggcaccgtccaatgaacatttttggcgattctgtcagtccgtatataatagacatcctctgaatattgatagaattcctttgtcgcctgttttgggccgtataatgcttttgtctcttcaaatttgcgaatgacctcggacggggcaggcacaaaacagcccatcagctttgcgctgagcaggtcacggtacgtatctgtatccgcttccattcggccggtttcggcagcccatttatagatgggagctagcaagtccggcaggctttgtgactgcttgatgctggtgctggagttcggctcgggatgtgtgatgcccagcgcttcataaagacggtttctcgtatattcccgatcccagatcgaaatcaattttcgttccaggccatactcaagcagctgttccagatgttcaataatactcatatgtcactccccctttagttctctcgctccctctccgatatccgcgacataaaaatccgctcggagccctgtttttgcttgatatctgtctccaaccttctgaataaaatcatcaacgaactcatcttttacaatgctgatggtgcatccgccaaagcctgctcccgtcattcttgatccaattacaccttcgtgatcccatgccgcaaacacaagctcatcaagttcagggcatgttacttcatagtcatccttcaatgaaaggtgggattccttcattaactgcccgatttcatctatattgttctctttgaacatatgggccgtcttaatagcacgatgattttcgtatacagcgtgctttgcccggcgtctgttcgtttcattttggatcaggctggaatgcgcatcgaaatcagaaggcttgatgtcgcccagtgcggcaatatcgaggccttttttcaaatcaagcaatgcatcattgcattcttggcgtctcgtattatagctggagtcagccaatgtcctttttttgttcgtgttcgcgatgaccagcgcgaggcctgagacattgagtttgctatattcatagtcaagcgtgtcgcagttcagcagcatcgcatgatgttttttccccattccaattgcaaattggtccataattccgcaattgacgccgataaaatggttttccgcatgctgcgccattttcacaagctcaagcgcatctacttcaggatgaaaatagcttcggagcacgacccccatcagcagttcaatagaagcggaagacgacagccccgccccgtttggaatattccctgaaaatacaatgtcaaagccatggggaactgcatatcccctctgttgaaattcataaatcacgccttttgggtagttcgcccagtcgtcttctttttgatagcgaatgtcgtcaaggctgcattccttgatgcctgcgtttctaaagttatctgaatacatccggacaagcccgtcgtttctttctgcaacagcagcatatgtacccattgtcagcgcgcacggaaatacatgcccgccgttatagtctgtatgttctccaatcagattcactcttccaggtgcgaaaaaaaaccgtaacccctctttttctccgaatacacttgcaaatatcccctttagctcttcccgcatgtgcaatcacctttctggtttttattttttattccccttatttcttcatagaaaacggcagatcatatgctgcagtcctctcataccccttcttcttttgtttttttaaagacgagccatttgctcgcaacatagttgacgacaacaatgaccgcgttgtcgagtattttggccaaggtttcatttgtattgaactggccgacaagaatgatcatcatgcctaaatctatgccgagagacaggacccgaacgctgaaaaaagcagtgagctctttcagcaggctctgcagatcatgtgttttttgctgaaacacatataatttatttgttatgtaagcaaacagcacggacaaaatccaagcggcaacagtggcggctttgtaatccacattcatgatctctaccaatatataaaagctggcgatattcacaatggttgtgaaaacccccataatgatatacataattatttctctatacttcactgatgttcctcgctttctgaaaaacttttcaaaattcttggcgtctcgtgctctctgtctaaagtaaaaaataccgagagtgcgtctaaaaagctgcggaaggtggctggctggcccaatacatatgattgtttgatgattccgtcgaggactgcacatattattttagccgtatattcaggatcaatacaggcgtcaatcagctttctctccttcagccacttaatatataacacattttcttccacccacaattcgtacagccggacataggccttgcatttctttaagactttatatgtcggcatgttcatggcaaacgaggtgatgtcccacgacggcttatttatgtaataggaataaagcagttctgcagcgtgttttgcagcctcgtccaatgtcagcgatttcactgactcccgctccatttgatcaagataccctataatgatcttttttttcatctgacgtttttcgagaagatacagcagaaaatcgtccttgctgacaaaatgaacataaaatgctcctttgctgtatccggcggctctgctgatatcttctacagaaaccggatcatacgctcggtcaatcaacaaattcacgccagcgtctataaaactttcaaatgttgcttctcttttaatttgaaatttgttttttttcatatttttctcctggcggtaatgattacccttatcttacaccggatcaatctttagcggtatttatttctttgaacggttatgctattcggtttcccaggggtcatttttaataggctaaatgatttattttcatttacatactatccagtcagtatttaattgtttattattataaataaggtccattggttatattagtcatttttttagggaataggtaggtggtttttccttcagtttgtgaacaccgagcaactatgtgtgaaatttgttgtactcgcctcatcatcgcgctggcttgtcttttattgcccgcatgttgcaggaaaacattttatacaattggaggttactatgaaaactcatgttaaaaaagatttggacaaaggttggcatatgttaattcaagaagctagatccattggattaggcattcatgatgtgaggcagtttttagaatctgagacagcatcgagaaagaaaaaccacaaaaaaaccgtccggcaagactagtccgaacaggcggatctatttacctctggcttttctatcacctgatctgagttttcaccatatcctctatttcgaaagcacattgctgcgcttagcttgaggacaaacggtgtgtcagctaactacgacagacagccggtgatgcgaacatgataaccgtgctctgataaacagcagctttgccgagaaaaagctgcattcggtgaggttttgaaagcaaactcgtttatacacggccgagcttgaaaaccttcgcctgtctttataccactgtgttcacctcttcacgacttccttcttttttcatcctccaggtatagttcaacgcataaatcagactttcagtacatacctattggtgtacctttttgcttacgtatagcgaataaaaggaggaaagccatgtacaaagctgattacaaacagattgctgcaacgccgtctttccaagcttttttaaagcagaaacgcgcttttattgttccttctgcgattttcttttttgtcttttatttttcactccctgttttgacatcttatttcacctttttgaatgcaccggccattggagctgtttcatgggcttggctgttcgccatcgcccaattcgctatgacctggatactgagtactgtgtattcccggagagccgcccatttcgataagtatgtaagcgctttaaaagaggatctgaagggtgaacagacatgaatatgactgcttttttattatttttggcgattgttggcctgacgcttattatcacgtattttgccgcgaagcggacgaaaacgacgagtgagttttatacggcgggcggcgggctcaccggcgttcagaatggactggcaattgccggtgactacatgtctgccgcctcgtttctcgggattgccggaatgattgcgttatatggatttgatggcttcttttacagcatcggttttctggtggcttatctcgttgtcttgtacatcgtggcggagccgcttcggaatcttggaaagtacacgatggcagacatgattgccgctcgctttaaagaaaagaaaatccgcggtgtcgcggctctcaataccattgccatctctactttttatatgatcgcccagctcgtgggggcgggcgcgctgatcaaactgcttctagggctggattataccgcggctgtcctcatcgtcggagtgctgatgaccatttatgtcgtgtttggcggcatgatcgcgacaagctgggttcaaattattaaagccgttttgctgatggccggcacactcgtgatttcgattatcgtgttttcgaaattcggctttagccttaataccatgtttgaacagatgaaaacggctactccgcttggcgctgattttatgaatcccggaaataaatacaaggtgccgcttgagaccttgtcgttaaacttggcactcgtgctgggaaccgccgggcttccgcatatattgatccggttttataccgttaaggatgccaagacggcccgtacatccgttgtgtcagcgacatggattatcggtgtgttttacattatgacggtgtttctcggctttggtgccgcggcatttgtcggttttgacgcgattacagcggctgatcaagcgggaaatatggcggctccgcttttagcaaaagcgctcggaggagactttctgttcgcgtttgtatcagccatcgcctttgccaccattttggctgtcgtgacagggttggtgctgtctgccgcctcagcatttgcccatgatatttacagccagatcatcagaaagggagaagcaactgaaaaagaacaaatgaaagcggccagatgggcttctgtcgccgtgtcagtactctcgatactccttgcgatttttgcacaatccttaaatgtggcgttccttgttgcactcgcgtttgcggtagccgccagcgcaaaccttccgctgattgtgtttacagtcttctggaaacgattcaatgcctcaggcgctttatggggcagcctgacaggcctgatcagcgcgcttgtgctggtatcgatgagccctagtgtgtgggacccggccggaggtgctatttttaccggtgatccgctcattccgctgtctaatccaggaattatttccatcccgctcggctttctcggcgcgtggctcggaacggtgctgtcgtctgataaaacaattgatgaagatacgtttgcagaaatacaggtgaaggcgcatactggcgtccatatggaacaggaataaaaaaagctctctttatagagagctttttccttactttttcttctgctcgtcagaaatcgctttttcaaatacatccttgccggcagcacccggaattacagtgtcaccgataataaaggttggaacggctgtgatgtcagcctcttcataggcgtgcttcaaggcttggcgctgcacgtcctgatatgttcttgtttccagtgctgatttgaatgatgcaccgtctaatcccacttcctcggcgagcttcgtcaagatgtcaatgtcgccgatattttggccctcttggaaaaatgcctgaaagacacgggtgttgtattcatgtcctttattgtattccttcgcaaaatggaagccttcaaacgcgaggtctgtatacggatggggcgagacgtttggaaaattgatctcgactcctaatttctccgccattggctgaattgatgtctgccacatgtactgtttggaaggatcattgaccggatcaagctgaggagatgggcttgggcgcagttcaaacggcatccactcgacttcaacatcctttccttttatcgcttcttcaaaagcggcttttccaacaaaacaaaatgggcagacgtaatctgaataaactttaatgtgtactgtcatgataatctcctttcatactaaattgattttaaactgtaacaattaaagttacaactgttttttaaataaagaagccgatttaggcttcttttatgattccagcaaacgctgggcaatatattctccttttttgcagccgcctgggcatgcgtataaagcagaaccgattgtttgtgtatattcgtttaacgcatcctttgctgaaagagccttcagcatcgggataaactgattgtcgggatttttttgaaaactgataaacagaagacctgcatccatatagccggttttcggatcaagcccttctgtgtaagagaaagctcttctcaaaatttgttttcccgtagatttcgctagactgacgtgtgaattagacggaatttgattcaacttcacgggatctgtttcctttttctgtccgaaaggcgcccctgagctttttctgcggccgaaggtatcctcttggtccttgagggaagagcggtcccatatctcaaggaacattttgattttccggaaagccatataggtgccgcccgtcatccagtcaggctcaccggactgaacccacacgatcgagttcatcaagctgtcatcctccgtgctctggttgcctgttccatctttaaacccgaaaagattgcgcggtgtttcgccattttttcctccgcttaaaaagcctttgttcacaaagcggacctcacaagtgccgaccgcttgatttagcaggttacgcagcgcgtgaaacgccacttgctcgtcgtctgcacacacttgaatgcagatgtccccgcctccctgcttttcatccaggttgtcattgggcatcgctggaagagcggctaggtgcttcggttttttgcttttcagcccgaaacggtcctttccgtctttttcaaaaaagccaggcccaaatccgaatgtgaccgttaagttggaaggggataaatcagcagactcacctgtatcctgcggcggcagatattgatttctctgctccgctgacattttcttgccagacgtcagcatctgtgtgagacttgtccagtttctaaataatgtaatgatgtcgcttttgtcttttgctgttacatccagtgcagcaaaatagacatacgtctgatgggcagttgtgattccggcctgatgctttccgtaaaacggaacaatctgctcctcctctttttcatcctttttcgatggcttagccgcagtctgaacaagcggagcgagaccgccgagtccgctggcaccaatcgcaacggctgcccccgccattgccccccattttaaaatgtcccgtctgtgaatttgttctggctttttttgttcatcgctcatgctgttacaaaactccttttatagcacattcgcaatcttcgacatggtttcagaaagagtcgtcagctttgtgctcagctctctgatttgcttttcacttaatttatcataagacgtataggactgatcatttgttttgtattttgccattaaaacttcaaattcgctgaactccgtatccagtttttccgtcaagtcggagtgatcttttacaagcgcgcttttcactgtttgataaacggcttcggagccttccacatttgccataaggtccactaaatcaattcgtgagtagcgctcttcttctcccgtgattttcgaaattccggcttcgttcagaagctccatcgcgcctgcaacaatttgttcaggtgttaatttcagtgattgaactaaaccgtcaagctcttttacatccttgagaagctggtcagctgttgccttttccccggaaatatcttgatccttccaaatggccttctcaagcttatggaagcctgtccatttgtctccttcttcaacatcgttttctcgagcatcaattttcggatcaagatctccgaggctttcagcgatcggttcgattcgctcgtaataaacacgcgctttcgcatataacgttttagatttttcgatatcgccggatttcacagcgcttgtaaatgcttcagtcgctttgacaagctggtcactctgctctttgacatagcctttatactcatccgctgcttttgccagctgatcgctagcctttttgccgctcttcttcgcttctgtcaggtcttctaaggatgctttcaatgactcggattctgtcttgatttttcctgcatccggtttgtctttttgcgcttctgtgtagattggctgaagatgcttttcgatttctgtatattcgaatggatagtcgctgcgaatatcgttttcaaaggaaagccagtagctgtttaactctttccccttcttttcaatctctttttggtctcctttttccactgagtcattcagcttagaaatgatggtttccattttatttacggatgcggtgatttctttagtgaccccgcttttttcagatgaagctttttctttagttgaagatgtgtcattggctccgcagcctgcgcacagcgcaaggatgcatccggctgatacagcgatttttgtgaaattcattttgtcagttcctttccgtttgtaaaatgttttgccgcttctgaaacaagcgcaatcagtaaaaagagtaaaatcaacatttgaggaatcgtgctgtacacggacggataaattcctagcaccgatacagacggcagccagctttctgcatcagacggaagaatgcccgccagttgaaggctgtgaacgccggttccgagaaatttcacgcacatatacaggacaaccgccattgatagaagaaaaaacggcttcaatggaatgcgcattccgagcttgatcatcagaacaccgacgatgacgagaacgataagccctgcggcagttccgccgatcagttcagtgagcgggagcttcccgacaagcccgatgaaaaagatgaccgtttcgagaccttctcttacaactgccagaaatgcaatgagcgcaaaggaaagcaggcttcgtttttttagtgcctgtgacttctggatattgattttttctctccatttatccattgaggcgtttctgtgcagccacaccccgacatacaaaagcatgacagcggacagtacgccggtaacgccgccaagcaagaaattgttttctccgaatacactggaggagaacagaaccgtgacaccgatgccggctgctaaggaaacagccatgccggcggacgccccgccccagatccatgccgaggagcgcgtgacccgcgctttttttgtcatggttaatagcgctccgatgacaaggagggcctccatcccttcacgaatcgggatcagcgccgcgtcccaccagctgtagctgcttgaagcgatcggctcgagcaattgaatcatttcgtcaatttgctttgataccttttcaggatggctgccgatctccgccttcatcagagccagattttcctccgatgtcgtataggcttctttcgattgggaaacgacgtctccctcaacagcgagccaggatgtaactaaattgtcgattgcggatgacgcttcatccaattgctttttttctatgaactgttttgtgtctttcaagctttgtatataggctcttaaggacgcccttgattgacctgaggatgtctttttcagcacgacagcctgctgataggtttctaaatgagacgcaagctcttcaagctgtgttttgagcttacctgcgtcttgattgataaaagaaagagaaatcatcgcgatattcgcgtccatttcactgtgagaagaaaggttttctttcttaatagaaggttcttcttttttccacttcgctttgaagatttcaaacgtttgttgtgccgaatccatatccccgtcttttacggatttgatcatttgcttgtttaattgaattaatgcggcgatcggatcatcttccgcatgtgccgcagaaccgaaaaccatcaacaagctgaatagaataagtgccagcccccgagccatcatgttcctcctataattgaaaatgattatcattgtataacataatcatagccagttcttgtcctttgtcaattaaaatttgaaggtctgaaaaccttgatggacagcaaaaaagctgtccttttacagaacagccttttgaaggaagatgaacgattatctttctgttttatatgtttgaatttcctcacgaaacttgcgtgcagcactctcaggatcttccgcctgactgatggcgctgatcatactgacgccatcggcccccgcttggataacaggtccggcattttctattgtgatgccgccgatgccgacaattggaatgctgatgccttggcggcgcactgcttcaataagagatacaccctgtaccgctcttgtatcctttttcgtttcagtcggatagatcggcccaagcccgacataatccgctccgtcttcttcggcttgctttacctcagacatcgtatgagcggaaacgccgagaatcatatcacctatggcagctcttacctctttcgcatttgcgtcttcctggccgatgtggataccgtcagctttcagcttcagagccaattccacatcatcattgacaatgaacggaataccagcttcacggcaagctgcctgcgctttttcagcaaattcaatccgagcctctcctgtcagcgcatccccgcctttttcacggaactggtacagggtggcaccgccttttaacgctttttgtacaactgtaacaggatcggctttcgtattgtttgaccccataatgaagtaaacagataataactctttcatcatttcccgagaaatacgagtcatgagacagtcaccctttctatagccgcccattcttggacgtcttgttcagtaacagttgaaagcttgttcagcaattcaatctgaaagcttccagggcctttgtcagccgtctgctgtgcggcaaactgagcggcgaccccatacgaagaaatggccgcaatagcagcaaacaatggattttcttccacagcgcaaaacgcaccgacgacggaagtcagcaggcaaccggcgcctgtcacttttgtcagcagcttgtggccgttatgaagggtgtatacatgtgacgtgtcggctatgacatcaacttcaccagttatcgcaatgaccgtgtttagcttttgtgccgcctgctgagccagccggatgatgtcgcctccgccttcacccgcatcaacacctttgatcagccaatcggtcacgccgacggtatgggcaatttccgccgcatttcctctgattgcagcaaggcgcacctcacgaatgatgtcacgtgccgattcagtgcggaacggtgttgctccggcaccgacaggatcaagaatgacgggaacgccatgttcattagctgatttccccgcgatgatcatcgcttcgactgactccttgctcagtgttccgatatttaaaacgagtgcacccgcaattttcgccatatcggcgacctcttctttcgcgtatgccataacgggcgatgcgccgagcgcgagcaggccgtttgctgtgaaattcgttacgacattgttggttatgctatgcaccagtgggctgtgccggcggacagcagtaagacattttgctgctgattgtgcatccatgtttgcatcatcctttactatcttttttcgggtcccataaatacgatttcgtatgttcgagccaagctctggcggcaaacgacaagtaccggtcctttctccaaataatggcgaggtgccaagggatgaccggatcgacaagcggaatgactttcactttttccgggtcaaggccgcggcagatccgttccggcaaaagcccgatcccaaggtttgctgataccatctcactgataaaatcccattgtgatgtttcataaatgatatggggccggaacccagccttgatacattccgtcataattcggttgtgcaggacaaaatcctctctgaagaaaataaaaggctcgtccttcaactcacgcagctgacattctttctcatcagccagccggtgggaagggtgaacgacaagcattaaggtttcttttacgattgtaaacgaatgaaagatatcttcgtttgcgggaaggaccacaacgccgatatcaagagagccgtccccgacaccttcttggacttttatagaaccgtcttcgactagctgaaaggtgacattcggatagttttcacggaaatcgccgagcactctggggaaaaaccccgatccgatcatcggcggcagtccaatccgtacgtgccctttcttgacttccataatatcatttaattctgacgtcaggttttgaaatgatttaatgatttcctgcgcctgcacatacatgctatggccggcatcagtcagttctacctgcctgccgtttcggtaaaacagttcaattccgagctcttcttctaaatttttgatcatttttgatatcgtcggctgagaaacataaagggattgggaagccttcgtaaaactttttaaacgggcgacttccaagaaatatgttaaatggcggatatccatgtgcttcaccctttctatagacaaaaggaatacttcttattcttaatatatattttacctatagcgagaccttatgtacaataagtatataagggaggcatcaatatgaaaaaactgttgctaaccgttattcaaatcgctctgttatttatatttgctcggctgattaattgggtgacagcccttcttcatataaatattcccggcagtataatagggattgtgattcttttcacattactgcactttaacattatcaagcttgaatggatagagcttggtgcagcgtggcttctcggggagctgcttttattttttatcccgtctgccgtcggagtgattgaatacggagacattatgtcgaaatttggtgtcagcattctgcttgttgtcatcatcagcacgtttgtcgtgatggtgtctacaggaacgcttacacaactcattgcaaagagaaaggagaaaaagcatacgtgttcatcggaattgtaagtttgtttttaacggttttggtgtatttaggagcaaaaaaggtatatcaacgctttccgcgtgtttatacgtcgccgctattggtgacgcccgctgtgttagtcggtctgctgctgctggtgaatgtcccgtacgagtcctataatctcggcggcggattgctgaccgatatgctacagccggccaccgtggcattcgcgatcccgctatataaatatttccctgttttaaagaaatacgcagtggaaattattttgaatgtggccgtcggttcatgcatcgcgattatttctaccgctcttattgcgaaatggcttcacctcggcaccggcttaattgacagcctcgtcccgagatcagtgacaacgccgatcgcgatgaacgtatctgaaatgatcggcggaatgcctgccgtcacagccgtgtttgtgattttaaccgctttgctcggcacagtgatcggcccgatggtcatccgctatttccgtattgataacgaaatcgcgcggggcgtgctgctcggcacaagcgcacacggagcgggaacgtcaaaggcatttgagctcagctctgtgtccggcacgatttcaagcgtatcgatgatcttagctgcgattatgacgctttgcgcggcgccgtttttactttcatttatgtaaaaaactgtcctctcgagggcagtttttttatgtgcttccccttattgaaaagctcgcaaattacaatataatgtaatttgtggataccaaaggaggcaccttgatgcacaacttgcaggtgagacggcattatgccgcgttaaaaggattttatttgtttgcttttctcggtacgggcagcatgattcccttactcagtatgtatttaacgaaggaacagcatttaagcggatcacaggtcggcttgatcatgtcactgggcccgattgtgatgattttctttcagccgttttggggcatgctgagcgactatacgcaaaaaacgaaaggcctgctggcggtttgcacatcaatcacaggcatcattggactaggctatattgcatttgacagctttcctctgtttattttgattgcggcctgttttgcagcctttcaaagcacgattattccactttcggacagcatttcactaaggtacacacaagaaacaaacggcaactacggcggaatccgcctgtttggctctctcggcttcggcgtcgcggtgtttgccatgggacaggtgacgaaccagctgtaccccattcacgtgatctttatctttggctgtgcctttctgtgcattgccgccatattggcttctcaaatgccgggccagcagaaaacgaaaacaaaggtcaatatccgcaaaggattccgggagcttatcagcaacaaaaccttcctcatctttatgatcatcacctttacgacatttgctccaaacttagcgaacaatacgtatttcagtctttttctggacaaaagcggcgcgtcactttccgctatcggcattttatttttcatcggcgttatttcagaaattccatttatgagattcgcccaaacatttatagataaaatggggctgctcaacgtcattatgctgtcaggcggagtctcattattcaggtgggcgctctatttcacggcgccttcactatggatcatttatgcgacggtctttcttcagggagtggccatcggtttatttatcccggcggcgcttcaatatgtgaaaaagattaccccaagacacgttgaagcgacggcgctgaccatgtacgccgccattggcaacgggttcggcaactggttctgcacatttgcaggcgggtacatttttgactacgtgtcgattttcgcagtctacttgctttttggcattctgagcatagcaggctttggcctgacattatatttaatgaaggctgaaaaaaacaaacatacacttcatcagccggctgttacttttaaaccataatgactataatgaacaaaagaaaggatgtgcgttatgaacgggcaagagcgaaacagcatttcgaaagggttgcaggttgatattgtattgaaagcagatcaaaaaacaggaaaactgacgagagggacagtgaaggatattttgacgaaatcaaactttcatccgcatggcattaaagtccgtcttgaagatggccgcattggccgcgtccagcagatcatttctacataaaaaaagctgcccctgaacagggcagctttttcattattttttctgcagaaggaccactttcaggtagttgccttccggaaatgccgaaatcgttttgaaatcctccggcagcgtaaattcctcaatgatggtgtagcgttcgtttgtttctttaaatgcggcatcgataaagcctttgaatttcttcatgccaaaggcgctgctgtttgtagaggcaacaatgacacccttgtcagcagtgatggcgatcgtttccttcagcaggtttttataatccttgaccgcgctgaaggtgcgtttttttgtgcgcgcaaaggaaggcggatcgagaataatcagatcaaagcgcaaatccttttttgcagcatatgaaaaatagttaaacacgtccatcactttaatgtcgtgcgcttcgtaatccagcttgttcacgctgaattgctcgatcgttttggccagacttcggtttgccacgtcgacgcttgttgttttctccgctccgccaagcgccgctgccacggagaatgcacccgtataagaaaatgtatttaaaacggttttcccttttgcatagcggtctctgatcgccttgcgcacgtgtctttgatccaaaaagatgcccgtcatggcgccttcattcagatccaccgcgtattgaatgccattctcctggatgatgatcgggaactcgccccttctccctttcacgaagtcatcatcttcaacgtattgtccagccgtgtcgaagcgtttcttctcgtaaatcgctttataatcaagatccatctcatccaatgcggaaatcagcatgtctttaaaggtgtaaatccccttgctgtaccattgaatcagcaggtagccgtcataatagtcgatggtgacgccgccgacaccgtcgccctcaccgttgaacaggcggaaagctgttgtatcttgagcctcaaatagtttggcgcgcgcttgggccgcttttgttaatttggtgagaaaaaatgcctggtcaacctgttcatgtttattgcgggtaagcgtccagccgacccctttgttttgcaggccataatagccccgcgcgagaaactcgccgctctcagacacgatatcaacgaggtctccttctttcatgtgccccgcactccctgcgagagcttctttttcaataaggggatagccttttttgattttggcagcgtgtgctttttttagggtgagtagcttcatatatgtcgtcctctttccgtttgctttctcttatcgtaccacaaaacgccaagatgtctgcattgacagaaaggaaaggtttttctacgatagacaaaaagagttacgaggaggagcagcatggcaaaacgaattgaccatacaggcatcatggtaagagatattaacgcgtccatcacattttatgaagaggtactcggcatgaaattgaaggatcgcatcacacacacgaacggtgtaatcgagcttgcatttcttggctttgaagacggcccggaaacagaaattgaactgattcaaggctacagcagcgagcttcccgctgaaggaaaagtgcaccacattgccctgctgactgatgacatcgcggctgaatatacaaaagcggaaaaaatgaacgcaaaatttatcgacgaggagatcacaacacttccaaacggataccgttatttctatatcgaaggccctgacggtgagtggattgagttctttcagcggtaataaaaaagcagcataacgctgcttttttattatttaaacacttacatcactacacatttttatccccagattcaaccgcactctcttcccgccatttttgatgatcccatattctgaaaaacggatagtagatagcacaggtgatcagcaggtttaccagctgcataacggcgcccgacacctttccgcctgtcgccaggtagcctgatatgagcggcggcatcgtccacggcaccgcgattccggccggtcttgccaccagcccggtgctcatgccgatataagtcgccgtaatcgtgaggagcggtgcgatgataaatgggacaataaggagcggattcatgacaatcggcatgccgaaaatgatcggctcgttgatattaaaaagcgcgggcccaatccctaatcggccaagctgcttcatttgtttgctgcgagatcggacaagcatcgtcaggacaagcgccagtgtcgctccgctcccgccgacattgatccaaatttgaaaaaactgagtcgtaaaaatactcggcagcgcctcgcccgcttggaaggcaagacggttggcatccatcgcgccgtaccaaatcggcgacatgattccgccaatgatggaagccccgtgaatcccgcacgaccaaagcagcatctgcacaaattcagcaatcaggcttccgccgagactgccgccaaggatggaaagcggtgtgccaagcaggtctcctacgacattgtgcagactctgaaaaggtgtcatttcaatcagaagacgcgccagccacacgagaaacacaatgataaagccgggaatcagcgcgacaaacgatttgcttaccgcaggcggcacaccgtctggcattttgaagacgatatttttttgaataatgtaccgatagatttcggttgaaaacaaggcgatcagcatggcgacaaataagcccttgctgccgagcagcgtgatcgggattccgccccctaccatgatggactccgttgagccatgcggtgtaaacggcacctcaaacggcgttgccagcagaaatgcggcaattgaaatcgctccggcagaaagggcatcgacaccatagctttctgccagccgataggcgatcccaaaagcggcaatcatcgccataatatcaaacgaagcattgacgggatatccgagcttatcagcccactctttcccaaacacactcgccatgaaatcagcataccccggaatcggcaggctcgttaaaatcaagaagacagatccgataataatcagcggcatggtcaggataattccgtcacgcaaagcgctgagatgccgctgtccggcaattttcccggcgacaggcattattttttcttccattacccgagtgaatgtgctcatcttaaaagcccccttttctcattgctttgtgaacaacctccgcaatgttttctttatcttattttgaaaacgtttacaaattcatttggaaaatttcctcttcctgcggaaaaaatctgcattttgccaaacaatcctgtctatgaaaaattttttccttctaactattaatctctcttttttctccgatatatatatcaaacatcatagaaaaaggagatgaatcatgaaaaacatgtcttgcaaacttgttgtatcagtcactctgtttttcagttttctcgccataggccctctcgctcatgcgcaaaacagcagcgagaaagaggttattgtggtttataaaaacaaggccggaaaggaaaccatcctggatagtgatgctgatgttgaacagcagtataagcatcttcccgcggtagcggtcacagcagaccaggagacagtaaaagaattaaagcaggatcctgatattttgtatgtagaaaacaacgtatcatttaccgcagcagacagcacggatttcaaagtgctgtcagacggctctgacacctctgacaactttgagcaatggaaccttgagcctattcaggtgaaacaggcttggaaggcaggactgacaggaaaaaatatcaaaattgccgtcattgacagcgggatctccccccacgatgacctgtcgattgccggcgggtattcagctgtcagttatacctcttcttacaaagatgataacggccacggaacacatgtcgcagggattatcggagccaagcataacggctacggaattgacggcatcgcaccggaagcacaaatatacgcggttaaagcgcttgatcagaacggctcgggggatcttcaaagtcttctccaaggaattgactggtcgatcgcaaacgggatggacatcgtcaatatgagccttggcacgacgtcagacagcaaaatccttcatgaggccgtgaacaaagcatatgaacaaggtgttctgcttgttgccgcaagcggtaacgacggaaacggcaagccagtgaattatccggcggcatacagcagtgtcgttgctgtttcagcaacaaacgaaaagaatcagcttgcctccttctcaacaactggagatgaagttgaattttcagcgccggggacaaacatcacaagcacttacttaaaccagtattatgcaacaggaagcggaacatcccaagcgacaccgcacgccgctgccatgtttgctttgttaaaacagcgtgatcctgccgagacaaacgtccagcttcgcgaggaaatgcggagaaatatcgttgatcttggtaccgcaggccgcgatcagcaatttggctacggcttaatccaatataaagcacaggcaacagattcagcgtacgcggcagcagagcaagcggtgaaaaaagcggaacaaacaaaagcacaaaccgatatcaacaaagcgcgagaactcgtcagccagctgccgggctccgacgccaaaactgtcctgcacaaaagactggataaagtacagtcatacagaaatgtaaaagatgcgaaagacaaagtcgcaaaggcagaaaaatataaaatacagcaaaccgttgatacagcacaaactgccatcaacaagctgccaaacggaacagacaaaaagaacctgcaaaaacgcttagaccaagtaaaacgctacatcacgtcaaagcaagcgaaagacaaagttgcgaaagcggaaaaaagcaaaaagaaaacagatgtggacagcgcacaatcagcaattggcaagctgccggcaagttcagaaaaaacgttcctgcagaagcgccttaacaaagtgaagagcaccaatttgaagacggcacagcaatccgtatctgcggctgaaaagaaatcaactgatgcaaatgcggcaaaagcacaatcagccgtcaatcagcttcaagcaggcaaggacaaaacggcattgcaaaaacggttagacaaagtgaagaaaaaggtggcggcggctgaagcaaaaaaagtcgaaactgccaaggcaaaagtgaagaaagcggaaaaagacaaaacaaagaaatcaaagacatccgctcagtctgcagtgaatcaattaaaagcatccaatgaaaaaacaaagctgcaaaaacggctgaacgccgtcaaaccgaaaaagtaaccaaaaacctttaagacttgcattccaggtcttaaaggttttttacattctaagaacatcgtacacaacctttttcccatcctcctcacaggcttttcatactattgctatacagccatgaacagcataaaatgaacgttattacagttatcaccacatatggcgggattgtgactgggcaggcaggcaagacccaatgatgcaaagggagtattaatgcttaaaaagcaggacattttaactcttcttttcgtgttgggctcataacggcgccttggacaaccccctattctcatgctccgtcgtcgcgtcgacgcgggcatttttgtcattttcagccgttatttctcacttttttcattttgattgtcaacttttcatttgatacgatgaacaagccgacttttcttcagcaaaggaggttttgattgcttgcataaagagattgcaaaagaattactgctgctcgcaggaggaaaaaacaatattatcagcatcagccattgtacgacccgtcttcgttttgatgtaaaggacgagacgaaaattgatatacatgccattgagaacctgcaaggtgtgcagggcacctttttccgctatgggcttttccagattatcttcggagcaggcttcgtcaacaaaatatataaagaagtcgttcatgtatgggagaccgcggcttctgaagaacctgtccatcagaaaaaagccagccggaagctgaaccctgccgcagcttttgcgaaaacactgtccgatatttttgtgccgattattcctgcaataacagcaagcggcctgctcatggggctgatcggcatgattaaggtgtttcattggttcgctgccggcagcccatggattaaaatggtcgacctcgtgtccagcacagcctttattttactgccgattttagtcggcttcagtgctgcacggcaatttggcagcaacccatacctaggggcagtgattgcagggcttttgacgcatcctgatctgctagacccgtctatgctcggcagcaaaaccccgtcttctttagacatatgggggcttcatatcccaatgatgggctatcagggttccattataccgattcttctctccgtttttgtcatgagcaaaattgagaagctattaaaatcgattgtgccgaagtcgcttgatgtcgtgatcatcccctttattacggtcatggtgacaggatgcctcgcgctgattgtgatgaatcccgccgcgtccatcatcggccagatcatgacacaatcgatcgtctatatttatgatcacgccggcattgccgccggagcccttttcggcggcatctactccaccatcgtcctatctggattgcatcatagcttttatgcaattgaggcaacgctgcttgctaatccgcatgtcggtgtcaactttttagtgccgatatggtcgatggcgaatgtggcccaaggcggagcggggcttgcggtattcctcaaaacgaaacaatcaagcctgaaaaaaattgcgctccccgcttctctgaccgcgtttttaggcattgttgagccgattgtattcggggtaaatctcaaattgatccgtccctttatcggagcagccatcggcggtgctattggcggagcatacgtggttgcggtacaagttgtggcaaattcctacgggctgacaggcattccgatgatttcaatcgtgctgccgtttggcgccgctaattttgttcattatatgatcggtttcttgatcgcagccgtctctgcttttatagctacattgtttctcgggtttaaagaagagacagaataactggatttattcgatttcattcataaaacgggggatgaaaggacaaaaaagctatgaaaattaaaagaatcttaaatcataatgctatcgtcgtaaaggatcaaaatgaagagaagattctcttgggtgcaggaattgcgtttaacaaaaagaagaatgatattgtcgatccgtcaaaaatagaaaaaacctttatcagaaaagatacacctgactataagcagttcgaagagattttagaaacattgcctgaagaccacattcagatttctgagcaaattatctctcatgccgaaaaagagctgaacatcaaaatcaacgagcgcattcatgtcgctttttcagaccatctttcttttgcaattgaacgcctgagcaatgggatggttatcaaaaatccgctgctgaatgaaatcaaagtcctttatccaaaggagttccagatcggcttatgggccagagcactgattaaagataaactggggattcacattcctgatgatgaaatcggcaatatcgccatgcatatccacacagcaagaaacaatgccggcgatatgacacaaacgcttgatattacaacaatgatccgtgatattatcgagattatcgaaattcaactgtctattaatatcgttgaagataccatctcttatgaacggctcgtgacccatctccgctttgccattcagcatatcaaagcaggcgaatccatttacgagttggacgcagaaatgatcgacatcattaaagagaagtttaaggatgccttcctgtgtgccctaagcatcggcacctttgtgaagaaggaatacggctttgagtttcctgaaaaagaattgtgctacatcgccatgcatattcagcggttctaccaacggtcagtcgcacgctgagacaaacaaaaaacgcttttgatcatctcaaaagcgtttttttatatctgtattattggttgatcgccgggttgctgatcgtattccacttcgtataggacatgtaatggaaatactcatcgcgatacggatgttttgtattggagttccaaggcttttctccgccgcagaagtgcacgattgccgggttttctctcgtttcattatattgcttccgccctaacagagtcgatggggttttcagctttaacatgatataggtttgagcgttccagcgcggatgaagttcataccactgatcatacaagatcgcattcagtgcatcttggtcatgcagcacaagaaagtcttcgtctgggtgttcattgataaagttgatgactttttctgtgatgttttgctttctccaagactcaaaatcaataatcatgatacctgagttaaaatacttccctgtatcagtgacgttcatttctttcaggcgttcatgctgccccgcatcctcaacagcggctacggtgtatggcgcaatgtctaagtcccatagcttagaaatatcctctaggacaagcgcatcacaatcgatgtaaatcattcgtttgatgctttcatccttaattaagtcgggaatcgaaatgcggtaatacgcggcttttgtaatatggctgctctctaccgcatgttcatacattttggtatccacttctaaaaactcaatcggcactccgaatttcaaagtggtttcttccagtctttttttgttatcaggcttaattccgccatcaatgacgtataattttacctctctctcctgatccatgttagtcaataaagaaacgaacatcccacctaaatgacgagcataattatcatctgcgcatgatacgatatgcatgatttcatctttcctcaatggtattcatctccctttttgttgtacaagttacataccctttttcaaaaaaataaacacgttctccgacatttttttaaacagaatgtgtgatacaacaaaaaaggtgtcattttttgaagatgcgataaagcaaataaagaatgaaaaagctggcgatcgtgatggcttcagccgagacgatataccatggccatggcccgagaacatctaagagagaggatccgcccggttttttcgtcaaatacatataattcgcgccaagccagcgatcaatcaggaaaatacagacgccgtacacattaacaagcaggactgtcacccataacgagcgctggcccattctgtaggtgccaatcacagccatcagcagacaggataaaaacacagacccgtgagaaataaaaaagaggatatatcggatatgcggaaatgaaaacattccgaggtcaggagtggcaagagcctgaatcgaactgccgatgccgacaaaaaacaaaaacacaaacagctttctgctttttgtcactaacataatagctgacaaatacaccgacaggtcactaagctggagaggcaatgaagtgcgcaccgaccacctgcccgtggcgaccatccatatttgatagccgatttgcgaaccaagcaaaagaaacacaaacagagaacgtaaaaaccggctggccctcggctgcttgaccccctcttggaacaaaaacaacagaatggccaaaagggcgataatcgctaacgtcactacatgctctgtcgaaaacagatgaaacggatcatgcttatagacggattgaacatatttttgcaaaactgcacccccgtttgcggttttttgtttattttggcgttgtttgggctttttttattcaaccgatatatgggcttgaagttcacatcatactctgttacaattcgtttcatagctaatgattctgataatttaaggcaggcctaaaaaatggaacgttcacatcaacatcagcagcttcggaaggaagaacacgatacactttctaagctcaaacaaatgcccgtcgagtcactcaacctggaagccatttcgatcgctacgaatctgtatcggtctgcacaaaggctccgtgtcaaaatggagactgaggttctttcttcctataacctttcttggaccgctttctccattctttatgatctatgggtatggggagcgctcgaaacgagaaaaatcgctgagctgtcagggatatctacagctacagcaagcaacgtgatcaaaacgctcgaaaaaaagaatttttgccgtaaaagcatcgacacaagagatcggcgactcgtgtttgtctctatcaccgattccggcaaacaagcgatcgaagaactctacccggagtttcacaaaggggaaacagagctcattgcgggaatgacgaaggacgaacagaaaatattgacagggctgcttagaaaggtagctgacaatcttcatacaacataagctttgacgggaatccagtagcggtttgtctccctgtttcagagagccggcggaaggtgcgagccggcacacagcaaacgtgaattacctccccgagctttctttgtgaaccttaaaagtagcaaagaacgggaaaccgttattcgaatgagcggaagacaatgtcttcaaccagggtggtaccgcgtgcattgagccacgtcccttatcgggatgggctcttttttgtgtttgtaaaaaaggaggaaaaatgatgagaacatttgagcagctcacagcgtcacagcaaaaagaggtagaaagacagctacagctatacatgacaggcgcccacgaagtcataccgccggaggaattaaaggcaaagctcgtgaaatcaatttccacgggcacgccgcttaaaattaagctcggattagatccgtctgcaccggatgtacatttgggccatacggtggtgttaaataagcttcgccaatttcaagaaaacggccacattgtccagctgttaattggggatttcacaggaaaaattggtgatccgaccggaaaatcggcagccagaaagcaactgactgatgaagaagttcagcacaatgccaaaacctactttgagcaattcggaaaagtgcttgatccagaaaaagtcgagcttcactataactcaaaatggctgaaaacattgaatctggaagatgtcattgaattagcagggaaaataacagtagcccgcctgatggagcgcgacgactttgaagaacgcatcgccatgcaaaaaccaatctcactgcatgaattcttttacccattgatgcagggatatgattctgtcgttctcgaaagtgatattgaattaggcggaacggatcagcatttcaatgtcctcatgggacggcatttccaagaacgatacaacaaagaaaaacaagtcgtcatccttatgccgctcttggaaggcttggatggcgtcgagaaaatgtcgaagtcgaaacacaactacattggtattaacgaacatccaaacgacatgtacggaaaaacgatgtcactgcccgacagcctgatgaaaaaatacatccacttggcgacagacttagagcttgaagagaaaaaacagctcgtaaaagacttagaaaccggcgccgttcatccgcgtgatgccaaaatgcttttagccaaaacaatcgtccgaatgtatcacggagagaaagcagcagaagctgccgaacactcgtttaaaacagtctttcaggaaaacagcctgccggaagatataccggccgtaaactggaaaggcgaaaaaacgatagcgatgattgatctgctcgtcaagctaaaactcctctcttcgaagagcgaggcgcgccgcatgattcaaaacggaggtgtacgcatcgacggagagaaaataacagatattcacgccaaagcagagataagagagaatatgatcatccaagtcggcaaacgcaagtttttaaagctccaatagtttgatattccgaaacgcttatgacccttcattcataagcgtttttttgcaggtataaagcactgtcttttcaaaaacgctcttcatcttgcaggaaactcctttagcatcccgaaatattccccaaccatacatttaggggaggtttatttttgatgaaaaagcttttgactgtcatgacgatggctgttttaactgccggcacactgctcttgccggcacagagtgtcacccctgccgcgcacgctttacaaatatcaaatagcgagcgcgagcttccattcaaagcaaagcatgcgtactctaccatttctcagctaagtgaagcaatcggccccagaatagccggaactgcagctgaaaaaaagagcgccctattgatcgcctcatccttgagaaaattaaagcttgatgtgaaggttcaacgattcaacattcctgaccggcttgagggaacactgtcttcagcaggacgcgatattcttctccaagcggcgtccggctcagctccgactgaggaacaagggctgacggccccgctttacaatgcgggattgggctatcaaaaggactttaccgctgacgtcaagggcaaaatcgccttgatttccagaggagacctgacttattacgagaaagccaaaaatgccgaagccgccggagcaaaagctgtcatcatttataacaacaaagaaagcctcgtgcctatgacgccaaacctgtcgggaaataaagtcggcattccggtcgtcggcattaagaaagaagacggtgaagcacttacccagcaaaaagaagccaccttaaaactaaaagcattcacaaaccaaacctcccagaatatcatcggaatcaaaaaaccaaagaacatcaaacatccagacattgtgtacgtgacggcccattacgacagtgttcctttttcgcccggagcaaatgacaacggctcaggaacctctgttatgctggagatggcgcgtgtcttaaaaagcgttccatctgataaagaaatccgctttatcgctttcggcgccgaagagctcggcctgctcggctcctctcactatgtagatcatctatcggaaaaagagctgaaacgaagtgaagtgaacttcaacttagacatggtaggcacaagctgggaaaaagcgtctgagctgtatgtcaacacattggatggccaatctaactatgtttgggaatccagtcatacggctgctgaaaaaattggatttgacagcctgtctctgacacagggaggatcatctgatcatgtgccattccacgaagccggcattgattccgccaactttatttggggagacccggaaacagaagaagttgagccgtggtatcatacccctgaagactcgatcgaacatatcagcaaagaacgcctccagcaagcaggcgatcttgtgacagccgcagtctatgaggctgtgaaaagagagaagaaaccaaaaaccattaagaaacaaatgaaagccaaagcatctgacatttttgaagatatcaaataaaaaaagacggcacttggttgccgtctttttttataataatcagctgtttagccgtctataagtaaagctttcagtttatcaactgtattttctttttctaacgggcgataaatggtcagtttcaaatcaggagagtcatatatttgtaatgtcatatgctccatcaccattgttccggctgccgggtgatgaagtactttttctcctgcgtgtgtgcctaatacttcgtggtggttccaccattttttaaattcggggcttctttcagttaactcatcgatcagctcttttatccatgcttccccaagaaaacggctggctgtcgatcgaaactgtgcgataagttttttggcgtggctttcccagtcgtcaagcagatcccgatactccttcgaggtgaaacatcgccatatggcattcctttccttactgcccatttggccaaaattgccgaacacagcacaagctgctgtgttccaagcaataacgtcccacttttcgtcagtcacataaacagggcaattggttaaatgatcaataaagtgccgcacagccagaggaaggctcttattatcttcatcctgatcatctaaaggaacatgatggccagccaacagaaagacatgacgcttttcctcataattcaatttgagcactctcgatatgctttccagtacctgtgtcgatacccgaatatcccttccctgctccagccatgtgtaccatgtgacacctataccggacagctgggctaattcctctcttctcaagcctgttgttttccttctggtgcccataggcaatccaaactcttgcggagaaagctgtgcccttttaagttttaaaaactcccctagctctttccgtttttctgccatactgtccacatacacactctccttctgcatagaatttcctattagtattctacataaaaaggagaaggtttttatattatttgtttcgttctccaaatacttcagcggccacaggaagaatggtattcagtgcattcgggaaacctgagtaaataatcatctgcatcatgacttctatgagttcttcttgtgtccatccgacattcagggctccgttaatatagaatttcagctgctgggtattgcccaatgcagtcaatccagcaacggttgctaataatctggatttcagatcaagacctggtcttgaaaaaatctgaccgtagttaaactccacggcaagcacaccaaggtccggagcgatggaatgtttaaaattgtccacgatcgcttcatagttctcctcatcaatttgtttcagaatatctaacccttttttataacgttcacttgttcgcatcagcttctacctcccttccaatatcgcttttttagtagtacgatttatggtaatccttgaactgaaggcaataccgaccatgatcatccccagaatacaaacaccgttccaatgaaacagcatccagactgcaccccctgcataagatcccaaggcgccgcctaaaaacgtgctgaccataaagatgccattcaatctgcttctcatttcagccgacaatttgaaaatctccgcctgacacgccacctgattcgcctgaatgcccatggtgatgaataaagcgcccaatacaatcacaatcaatgaagtctggcctgccattaataaaacaaatgacaataaggtaaaagacatacaaagcttgttggaaaaagcagctcctttttgatcaataatccggccgatcagcggagttgcaaaagccccgccaattcccaccaaaccgattgttccggcagtctggctgccaaacgagaatggaggttcactcaccataaacactaacgtcgtccaaaataaactgaaggcgccgaacatgaagccttggtttacacatgcttttcttaacactttctccttgatcaaaagcggaaataatgaagaaatgagttttccgtaatgaaatgcatgtgtccctttgcttttcggaaagcagaagtgaatgatcaacataatgatgacggctgctgcacaggcaatccaatacatcacgcgccagccataatgggcatctatcgccccgctgaccactctcgcccctaaaattccgcaaaccaagccgatggctacgtttccgagtacttttcctctgttcctgtcatttgctaaacctgccgcaaacggcacaaggatttgaggaataatcgtgaagaatcccaataataaatttgtgatgactagccatggaaagcttacagctaacgctgaagcggccgaacaaacccccactaagaatagcaggctcacaattaagcggcggcgttcaaaaagatctcccaatggaacaagcagaaggttccccgccgcatagccaatctgcgccaatgtagcaatcatcccagcttgtgccggcgtcacatgaaacgtgcctgccatgctgacaagcaatgtttgattgatatagacattagctaccgtaaacccgctagtcaccgcgataagaaaaatcaaacctctcgataatgaaatggaatggttcatgtttacctcctttcccatgcatgataaagcaggttcaattatggaaacagaagtgagtttatactggtataaaaagtactagcaagcaaagaaaaaaagcgaaaccctgtcaggcttcgcttttgttatcaatccacttctttcttaatccccagcattttctcatctaggtaatgggcaatctccgcggcttccttcagctcatctgttaattgcttaggaacgtcattgttcaatttataataaattttatgttcaaggctcgcccagaaatccatcgcgattgtccggatttgaatttctgctttgacgtattccacacggttcgttaaattcacaggcatctcaatgattaaatgcaggcttcgatagccattcggtttgggtgtctggatataatcctttacctttacgattctcaaatcttcatgctgcttcaacacattcacgacattataaatgtcagaaataaaggaacagatgatgcgcacgccggcaatgtcgtgaatatgctccttcatttccttcgtcgtaatctcacaaccctttctcattaacttattcacgatgctttcaaagcttttgacacgggattttgtatgttcaatcgggttgtgtccgtgaatgaggttatattcctggctgataattgagaactttgtatcgagcgcatctagcgcaaatttataaactaataattcatttttccaatcttccattactgtttttaaatcgtccatatgtgttacagataaatccatgttcgtcatctcctttaacggatctttatccgctgtccatgtactagacgtccctgtctgctgcaaggttctatgaatttttttacaaaatgcggtcgattgtaacaaaaaaagaccgcacgaaacgagcggtcttttttattatcggaaatagctgatcaataatccgatcgagagcaggaatccgaaaaatgtatttgtttgggctgttgatttcattgcgacaatcatattcatcggcatttctttttggacgaagcccttcactgcctgaaccggcttaggcacgctcaaaaagacgacaaacagccatgggcttgcggcaccggtaataaccaagccgacaacccagatataagcgacggcaaacgacgcagctaacagagtaacagctcccttatgccccatcaaaatcgccaatgttttgcggccgccttttttgtcctcttcaatatcgcgaatgttgtttgacaaattaatcgcgccgacaagaatcgcaatcgggatggaaatcaaaatgctttgcgtgttgatcatatctgtctgaatgaaaaacgaaatcagcacaaacaccgaacccatgcaaatgcctgagaataattcaccgaacggcgtgtacgcgatcggcagcggcccgcctgtatacaggtagccgatcgccatgccgacaaggccaatcagcgcaagccaccagctgctgctcgcacaaatatagacaccgagcaaaatggcaatcccgtatgaggccagagctaattgcaaaatcgttttaggcttcattccgtggcgtacaatggcccctccgattccgactgattctgctgtatctaacccgcgtttaaaatcataatattcattaaataagttcgtcgcgatctggatccataggcaagaaaacagcatagccaaaaacagcagcagatcaaccttcacataaaacatcgccaaaacggttccgagcagcacaggcacaaacgatgcggttaacgtatgaggacgggttaactgccaaaggatctgccccatgctttctttttgcggcgctgtctgaccctcacccttatttgtttggttcatcttcctcttcctttctattaaaaggcttactttttttcagccggcagcttaataaaaaactccttttgcttccttatctatcataatgacttctcccttatttcacaagataccgcaagaaggcgttttctttcttattatacgcttctcgccctgatttcattaggtttctgctttcacttgaacaaacaggcacagaaaaatttttttaagtacattacactttttaaaagttaaaaagatcttttgactccaggtatcttttcctttattatgaatcagctcgaaacattccattcttgcccttgcaggtataaagattcattttcaaaaacatacgccgatatattaatttgagggagattagggaaaaaatgaaactttttgagcatctgatcgtcaaataatcatgtgattgtcgaaaaaacgggaagggaatttttgatatgctgcaattaatgaaacagctgtatgaaaaacccgctgtcaagtggacatgtcatacaggcttttatttgatgatactgcttgttttgttttttatgtatggttttcacaccgcgaataccggttcatatatttataacgatttctaattggagagagaataactatgaaacttttacatgctattcaaacacatgcggaaacttatccgcaaaccgatgccttccgctctcaaggccagtcgctcacgtatcaggaattatgggagcagtctgaccgcgcggctgccgcgatccaaaaacgcatttctggggaaaagaaatctcctatccttgtgtacggccacatggagccgcacatgcttgtttccttcttgggaagtgtcaaagcgggacatccttatattccggttgacctgtctattccgtccgaacggattgcgaaaattatcgaaagctctggagcagaattgctgatccatgcaacaggactctcaattgatgcagtcggccagcagattcagacagtttctgcggaagaactgctggaaaacgaaggcggctctgtcagccaagatcaatgggtcaaagaacacgaaacgttttatatcatttacacttccgggagcacaggaaatccgaaaggcgtgcagatttccgctgcgaaccttcaaagcttcacagactggatttgtgcagactttccagtcagcggaggaaaaatatttttaaaccaagcgccgttctcatttgatttgtctgtcatggacctatatccgtgccttcaatcaggcgggactttacattgcgtgacaaaggatgctgtgaataagccgaaagtcttatttgaagagctgaagaagtccgggctgaatgtgtggacatcaacaccttcctttgtgcaaatgtgcctgatggatccgggtttttcacaggatctgctgcctcatgcggacacatttatgttttgcggagaggttcttccggtttctgtggccaaagcgctgcttgagcgtttcccgaaagcgaagatttttaatacgtacggcccgactgaagcgacagtggctgtcacatcggttgaaattacggatgacgtcatcagccgcagcgaatcgcttccagtgggcttcgccaaaccagatatgaacattttcattatggatgaacagggacagccgcttcctgatggagaaaaaggagaaatcgtcattgcagggccgagtgtaagccgaggctaccttggtgagccagagctgacggaaaaagcgtttttctctcatgaaggccagtgggcataccgaactggcgatgccggctttattcaagacggtcagattttctgccaaggacgtttggattttcagattaaacttcacggctatcgaatggagctggaggaaatcgagttccatgtcagacagtcacagtacgttcgttctgctgtcgtgattccttatcagccaaacggaacagttgagtacctgatcgctgctattgtgcctgaggagcatgagttcgagaaggaattccagctgacaagcgctattaaaaaagagcttgccgcttctcttccggcatatatgatcccgagaaaatttatctatcaggatcacattcaaatgacggctaacggcaaaattgaccgaaaacgcattggcgaagaggttcttgtatgacgccttacagctcgtttttattcttcatactgcttggcattcttcttctgccgacgatcattctcggcttaaacggaaaaagatttcaagcatacaacatgttcatatctatcattatattggctttaattttttcgcacgacttacacggggtcatcgcgctgtgcctgtttacaatatggcaggtgctcctgatcagcggctatctggcataccggcagaaagcgaacagcggctttgtcttttgcggggctgttatcgcgtcgattctgcctttatttctgtcaaaaatatggccgtttctttcgcacccgcagccgcatcatccgccgcataacctgatcagctttttagggatttcatatttaacctttaaaggcgttcagctgattatggaagcaagagacggactgctgaaagaacagctgccattgcaccgcctgctgtatttcatcctgtttttcccgacgatttcctccggcccgatcgacagataccgccggttcgtcaaggatgaacagaaggcttggacgaaagaagaatacgccgacctgttgtatacgggaatccataaaatcttcatcggtttcctgtataaatttattatcggctacgcgatcaatacgtacttcatcatgaatcttcccgcaatcacgcacaataagattcttgggaacctgctgtacatgtacggctacagcatgtatttattctttgatttcgccggctacacgatgtttgccgtcggggtcagctacattatgggcattaaatcaccagaaaactttaataaaccatttatcagtaaaaatattaaagatttttggaatcgctggcatatgtctctgtcattttggttcagagattatgtgtttatgagattcgtattttggatgactaagaaaaagtggatcaaaaaccgtatggccgtctcaaacatcgggtatttcctgctgtttatgctgatgggggtttggcacgggctcgcgccgcaatatatcatttacggcctctatcacgccgtgctgatgacgtgttacaactttttcgagaagtggaataagaaatataaatggctgccgtccaaccgctggacaaccattctcgctattgtgatcacattccacttcgtttgcttcgggttttacattttctcaggaaaaccatttcatcaccaccattaaaggagattagaaagctatggattttaaacaagaggtattagacgttttagcagaggtttgccaggatgacatcgtaaaggaaaatcctgatattgaaatttttgaagaaggtttgcttgattcttttggaacagtagaattgctgcttgcgattgaaaaccgttttgatattttagtgccgatcactgaatttgaccgggacgtttggaatacacctaacaacattgtaaatcagctgtctgagttgaaataatgaaaaagcgttttttcggtccaattattttggcgtttattctattcgcaggcgccatcgcaattccatcttcatggctgacaggcttcatcaccgataagcgtgtgaaagagtcagcaacagccttgaatccgagtatgtttcaagggctatatttacaagatcagatgctcaaagatccgacatatcttccgatttacgggtcttctgagctttctcggctggacgagttccacccatctaattattttcaggtaaacaatgagggattcacgccataccttgtcggcaaaggcggatcccagtcattgattcattctttaaacttcgctgcccatatggatcagctgaagggcaaaaaaatcgtattcatcgtgtctccgcaatggtttattaagcgcgggtctgatgaacagcatttcgcgccgaactattctgcgctgcaagggcttgatttggcatttaacgatcagatcgatcctgaaattaaaaagaaaatgatgaaacgcatgcttcgctttaaggctgtgcaaaacgatgccattctttctgagctgtacaaagcaatggtaaacggccagacgtggaaagtgaatgcgctgaagccggcggccaaagtgtattacagcatgctggaaaagaaagatctgtattattcaacgacagaatcatccgggccaaagcgctatatctcgcagtcagtaaaggataagtcatggtctgaattgaataaactggcggatcaatcaggcaaacgccactccggttctaacgattttcacatcgacaaccctgtctataaaaagctgaagccgaaagtgcctaagctgaaagggaaaaacaaaggaagatcgtatgcggtgtcaccggaatatggcgactttgaaatgatgctcgatatcctgaaggatgcgggcgcagagcctatgtttgtcaccattcctgttaacgggaaatggtacgattacacgggcttcccgaaaaaaggacgcactgactattacaaaaaggtaaataaacaaatcagagcgaagggcttccaggttgctgatttctcagggcatgaatatgacccgtatttcatgaaagacaccattcacatcggctggaaaggctgggtgtatgtcgataaagcaattgacgaattttataaaaccggaaaagtcacttcatcctgagcatctcataggacgcggctgcatatttcctgctaagatttgaaatagtaaaggaatcacagccaacttaattaagaggtgttacatccaatgaagatgacaggcaatacggttttaatcacagggggttctgctggcatcgggcttgaacttgccaagcgcctgctggagctcggcaatgaagttatcatttgcggacgcagcgaagcacgtcttgcagaagcgaagcagcagctcccaaacatccatacaaagcaatgtgatgttgcagaccgttcgcagcgggaagcattgtatgaatgggctttaaaggaatatccgaacttgaatgttctcgtcaacaacgccggcattcaaaaggaaattgactttaaaaaagggacagaggagctttttgtggacggtgatgaaattgaacttaatttccaagcgcctgtccatttatccgcccttttcacacctcatttgatgaagcagcccgaggcggcaatcgttcaggtcacatccgggcttgcgtttaacccgttagctgtttatccggtgtactgcgcaacaaaagcggcacttcactcgttctcgcttacgctcagacaccagctccgcgacacgagcgtggaagtgattgaaatggcacctcctatggtggacacgggcttaaaccaaaaatcacgcgataaacaaggcctgacgtaccggggcatttcatctgaagaatatgttcaatatttcttggacggcttgaaggaaggcaaacaggagattacaaatgaacgtgttgaaggtcttcgtgatgccactcgcgccgattatgacaggttattcgagcaaatgaacacgcaggagaattaatttctcctgcttttttcatatgaatttcttacaaatttgagcaaacctattgcgattatttgttgaaggtatacaatagaatataattattttcaaataagtttgataatataaacaatttaacagcagggagattgaccatgactaaacaaacaattcgcgttgaattgacatcaacaaaaaaaccgaaaccagactcaaatcagctttcgttcggaagagtgtttacagaccacatgtttgtaatggactatgccgcagataaaggttggtacgatccaagaatcattccttatcagcccttatcaatggatccggccgcaatggtctatcactacggccaaaccgtgtttgaagggttaaaggcttacgtgtcagaggatgaccatgttctgcttttcagaccggaaaaaaatatggaacgcctgaatcaatcaaacgaccgcctctgcatcccgcaaattgatgaagaacaggttcttgaaggcttaaagcagcttgtcgcaattgataaagactggattccaaatgcggagggcacgtccctttacatccgtccgttcatcatcgcaaccgagcctttccttggtgttgcggcatctcatacgtataagctcttgatcattctttctccggtcggctcttattacaaagaaggcattaagccggtcaaaatcgctgttgaaagtgaatttgtccgtgcagtaaaaggcggaacaggaaatgccaaaaccgcagggaactacgcttcaagcttaaaagcgcagcaggtagccgaagagaaaggattttcccaagtgctttggctcgacggaatcgaaaagaaatacatcgaagaagttggaagcatgaacatcttcttcaaaatcaacggtgaaatcgtaacgccgatgctgaacggaagcatcctggaaggcattacgcgcaattcagtcatcgccttgcttaagcattggggccttcaagtttcagaacgaaaaattgcgatcgatgaggtcatccaagcccataaagacggcatcctggaagaagccttcggaacaggtacagcagctgttatttccccagtcggcgagctgatctggcaggatgaaacactttcgatcaacaacggtgaaacaggagaaatcgcaaaaaaactatatgacacgattacaggcattcaaaaaggcgctgtcgcagacgaattcggatggacgaccgaagtcgcagcgctgactgaaagcaagtaagaaaaaagccggcccattacaggccggctttttttacgcttcaattttgttgaaaaactgcggcagatacgctttgtgcgcctccagcatttcgtctaaaatctgtttggccacagtatcggacgggacaagcgggttaatcgtcatggcaaggagtgcagtttggtagtcacctgtaactgccgcttctgccgcgacacgttcaaaggatttgatttgctggacgaggccacggacagacaccggcaagtcgccgacagcaattggcttagggccagttttcgtcatcacacagttcacttcaactgcggaatcgtctggaatgctcgctattgcaccattattgattgtgttcaccggctgaatgtcatgtttatcattataaatggagctgattaagttacatgctgcatcactgtagtaagctccgccccgtttttccagctgcggcggtttgatcgcaaggttcggatctttataaagctcgaacagctctttttcgaccttctgtacgacttctgcgcgggtgccctccgtttgtgatgcttccagttcgtgctccagcatctcttttgttttgaaatagtaacggtgatagccgcaagggatgacattgagcgcttttaagaaatccggttcccattcggcgcctgagatatttttcattgtcatcgcgtttttcgggtcgcccatcgcctcgatgacttgctccttcacacttacgccatccaagaaaacatccagcccaaataccatatggttcagtccggcgaattggacttctacgcggtccacatctacatcaagcgctttggctacgcccattttgatgccgattggaacattacagagaccgacgactttcttcaggttggagtagcgaagcaaggcttctgttaccatgccggcagggtttgtgaagttaacaagccaagcgttcgggcaaagctcttctatgtcctttgcgatctcaaggatgaccggaattgtgcgcaatcctttaaacaggcctcccgggccgtttgtttcctggccaatcactccgtattttagcggaatgcgctcatcctttgctcttgcctgcaaaagtccgacacggaattgggtcgtgacaaagtctgcgtctttcagcgcttttctccggtcgagcgtaagatgaatgtcgatcgggacgccagctttttcaaccatccgtttggcgagtgtgccgacaatattcagcttttcttcgccctcggggatatcgacgagccataattcgcgcacaggcagctcatcataccgtttaataaacccttccactagctcgggcgtatagcttgaacctccgccaatcgttacaatcttcaatccttttgtcatatgcttgctcccctttgctcggtgattttttcatataactcaatgatctctgcagccatatccttcactgtcattgcattcattaaatgatcctgtgcatgaaccatcagaagcgtcatttccgtcttttctccgcccgcttcattttggatcagctctgtctgataatgatgggcttttgacaattcttcagcagcgtcttgaagctttttccgcgcttcttctgcgtcaccgcttttcgcagcggcaatggcctccattgcggagctcctaccgtttcctccgtgaaggatgatttgaaaaatgatttgttccatttcctcattcacgcgattcacttcctttctctacagagccgcttctttgtcatctgatgctgcaggcgtttggaccagctccagatcgttttcttctttcagcttctgcttatcccacattctgaagaatggatagtagacaacaaaggacacggcaatattaatggcttgcatgaccgcacctgagacttttcctcctgtcgccaagtagcctgaaaagatcggcggcatggtccacggcactgcgatacccgccggttttgcgacaaggccggtgctcattccgatgtacgtaagtgtcactgtgacaagcggtgtgatgataaacggaagtaagagcattgggttcatgacgatcggcattccgaatataatcggttcgttaatattgaagatggccgggccgaccgcaagcttcccgagctgcttcatttgtttgcttcgggcgcgcaggaacatcgtgacaaccagtgccaatgtggcgccgcttccgccaatattgacccagatatcgaaaaattgctgggtgaaaatcttaggaagctcctcaccggcttggaatgcgatccggttggcatccattgcgccgtaccaaatcggtgccatgacgccgccaacaatgtttgcaccgtgaaggccgcaggcccataaaagcattttgacggcttcggcgacaaggcttcctccaaggcttcctcccagaatggaaagcggagtccccaataaaacgcttacaatattatgaaggctttcaaacggtgtcgcttcaacaatcagccgggctgcccaaattaggaagatgacggcaaagccggggattaacgcgacaaatgacttgcttaccgccggcgggacaccgtccggcattttgaagactaaattgcgctggataataaggcggtaaatctctgtggacaccattgcgataatcatggcgacaaataagcctttgcttcccatgagcgaaagcggaatcccgccgccaaccatgatttctttcgtcgcgccatccggcataaacggcacttgataaggtgttgctaataaaaatgccgcaagggaaatggctccggccgacaaggcatcaacaccgtatttctcggcgagccggtaggcaatgccgaacgcggcgacaagacccataatttcaaaggtcgcgtcgactgggtaggccagtttttcagaccaggagctgccaaacgtttttgccataaactcagcgtatcccgggatcgggaggttgccaatgatgaggaaaaaggaaccgatgataatcaggggcatcgtgaggatgataccatcacgcagcgcctgcaaatgacgctgtcccgcaattcttcccgctataggcatgaccttttcttctaagatctgattgactttattcacatagcccgcccctctctatgacacatgtccaagctgttcagctgatttcagcacttccgccccgttgcacgtgccataatggacggtattaatgacgtctaccggaaccccctttgactctcctaattttttgagctgtggaagcatgtaacggacttgcggaccgagaagcaatacatccgctttatcgatatgattttgtacagaatcgcctgaaactgcccaaatggtatagtcttttccctgttcctgcgcacttttttccatcttgctcaccagtaaactagtagacatgcctgctgcacaaacgagtaatatattcatgtaaaagaccccctagagtttgatcaattttgtaatgtcctgctgttgctatcatcatattatgaaatcgctttcataaacactcagggtttttccgcaggcaacggaaaaaaggtatatacaggctgtcagctcagcattttttggtcaaacacatccgaaagctcttgatacgaacggcatttgaccagctggttcaccgccgccgggtcatccaaaatgctgccaagcagtttatacatgctttgcaaatccgctttgttctccttttcgacacaaagcagacagacaaattgaactcgctgactctcccaatcgatcggttttttgagcgtacaaacggcccaaaacgttgttttcgtctgcggaacaagcgggtgcgggatagcaacaagattgccaaaacacgttggcgacatgtcttctctttcaaaaatggaatctatgatttcttcatcggcaaagccgcattcgaccgctttctgccctaaaaattgaatcacttcttcttttgagcgcagatcctcctgaaaaaaaatgagttctttttttaggtagcgattggctttttccttttcatcactcagaatagattctatttttgtaaagtcagttccgcctaagatggtgttaaccttcagtactggtacagggagctcttttttaatcggaatggtactgatgacaaaatcaattgattcgtaggacatttgatcaagactataatactcagccgttccaagaatatcgagccgcttgccgaaatgggaacgcagtttttcgcgcagaagctgggcgcttccggcacccgatgcgcatacaatgatacagcgtttcggcggactttctgttttttttcgttcaatcgcggcgccaaagtggagagccaaatatccaatttcgttttcatgaatctcaatacccgtttgttcctttatcacgattccggcaatgatcccggcttcaaaagcgagtggataatgttccttgatcgctgccagcatcggatttcgaagattcatgccgtatcggttgcggctgatcgccggcttcatatgcagtgccaagccgattttcagctctttgtcatgcaggatgccaagcttcagttcacgatcaacagctttgatcatggcaagtgtcagctgatcggtttcctcttctattgaaaatgtgtcctctccgcattgtgattgtgtcattcgttttgtgccaaggagatgcatggtgatgtaggccgtctcgtctttcggaaacgtaacggcaagctttgattccagctcttttacgatggcttctgcagcctggtactccttttgatgcaggatatgatccatatctttcgggaaaagagaaacatagttttccgttctgatccgtttacaggcgatagcgatatggataatgaggttattcagtcccatgttggacagagggatgcggtcgtttttcatttttttcaagatggcggaacggatgatctcaatttcttcttttggcaaaatatcagccttttcatttaaaacatctatctccgtttctctttcatcaacaatgtactccgccatgcagtacctcatctgcacctcgtccccgcgcagcttgaagccgtaattcggacgtgtttccatgacgatgcggtaaggcagcagacgtttctttacttcctttaaatccgtttggagtgtagattttgagataaatagttcttcagcaagttcatcgagcttgagataatggtccgccagcagcagacgtttcataagataggccattctctcctccggcaataccggcaggccctttttttgctgaaattcatcttgcagcagtgttctgaatacttgctcgtcatcaatgcggagcttgtagccggagcctcttacagattgtacaaaggcaccgtggccgcttagcacaccttgaagttcctttatatcattgcggactgtccgcgtcgttacgtttaattgcgcggcaaaaaacgaacttgtcaccggggcttcagccgccatcagcaagcgcagaatatcacgtagtcgcccatgaagcatgagaaaaacctcctaactagtagatgcagggattcagtgaataggcagaaaggatgatgaagggatgcgaaatgtatataaattctataatggagagaatggcaagtcaatgaacatccggaggactagagggaaaactgacctataaaaaaacagccgggatcagccggctgttctagatgcggacatattcttttgtttagacgccttgcggtccttcatgatttttcgaacaatcgggtaaatgaccggcgcccatttgataacggttttgatcatctttttcaaagctccgattctcccttcttttttctcaaccattcccctgattgcctcttccttaaacatgctaacgcgacacgtacctgtttcccgtcacccagaaacgccatggataatcgcgtgcctccccgctgttgtcaatgccgatgcgcgggccggttgaaattgcttccggtgtgtacccgctttcgatgtaaagcggctgttccgtgatccagcgtccgtagtcattcatcgtgacgccaagcgctttcgtcagctttcctggtccgtttgtccattccctcggactcctgcccggccttctctcctccattaacagctggccttcatgcggctcaatcgccctgattaatactgcttgcgggacatcctcttccgccgcaacgacattcagcaatgtatgggtgtgcatcacgtatgtatatacccgcccagcttctgcaaacatgatctcagtccgcttcgtccggcggttgttaaagctgtgggccgctctgtctccagcccccatataggcctctgtttccacaatatagcctgacgctgtgccttcgtctgtttcttttacaagaaggcagcccagaagcgatggggcaagctcaagagcggttttttgataaaacgtgatgggcagcggatttttttctctcgtcacgaatcgacctctccttttaccgatttttgtacattgtaccattcccgaagcagatcaaaaaaaacggctgttttaaaatctttccattcagggaatattgttaccgttcaaaaaaggagggccaaccattgaaagatgatcatcaaaacaagcagcaccaatcaaatgcccaagggagcgaggaagcgctttctcataagacatccgggaaaaatgagtcagaggataccttaacgaataggcaggggcatcctgttactgacaaccagaatgtgagaaccgtcgggaatagagggcctacaacacttgagaactatgattttctcgaaaagatcagccacttcgaccgggaacgcatcccagagcgggttgttcatgccaggggagcaggtgcacatggatattttgaagcatacggaagcttcggagacgaaccgatttcaacatacacaagggccaagctctttcaggaaaaaggcaagaaaacaccggcatttgtccgtttttcaactgtgaatcatggaaaacactcgcctgaaacattgagagacccgcgcggttttgctgtaaagctatatacagaagacggaaactgggatttggtcgggaacaacctgaaaatcttttttatccgcgacccgctgaaatttccggatcttgtacatgcatttcagcctgatccagtgaccaacatccaggatggtgaacgtatcttcgatttcatttctcaatctcctgaagcgacacacatgatcaccttcttgttttcgccttggggcattccggccaactaccggcaaatgcagggttcaggcgtacatgcctataaatgggtgaatgaggagggcaaggccgttctcgtgaaataccattttgaaccgaagcagggcatccgcaacctgacacagaaggaagcagaagagattcaagggaaaaactttaaccatgccacacaggatttatatgacgcgattgaaaatggcgattatccagagtgggaagtgtatgctcaaatcatgagtgatgatgagcatcctgaactggactttgatcctcttgatccgacaaaactgtggtataaagacgatttcccatggaaaccgatcggcaaattggttctgaacaaaaatccggaaaactaccatgcggaagtggagcaagcttcatttggaacgggagtgcttgtcgacgggcttgatttttcagacgacaaattgctccaggggcgtacgtttgcttattctgatacgcagcgctaccgtgtaggcgcaaattacctgcagcttccgatcaactcgccgaaaaagcatgtcgctaccaaccaggaaggcgggcaaatgcaatatcgggtcgatagagcagaaggacaaaacccgcacgtcaactatgagccatccattatgggcgggctgaaggaagcgaagcaggacggaaaagaccatacgccgcatgtcgaaggtgatgtaaagcgtgaagcgattgacagaacaaacaacttcggacaggctggagaaacgtaccggagatttactgaatttgagcggaacgaattgattacgaatttggtgaatacgctttctacgtgccgaaaagaaattcaggatcaaatgattgagaatttcacaaaagctgatcctgactacggaaaacgtgtagcagaagggctaaaaaaggtttccgaaaacaacagcaacgggccgatcggcacaactgaaacggaacaggctgcaaagcaggctgaacaggagagtcatccgtctgatccgtattaacaacagcgaacagggcttttttgaagccctgtttttttatttttctattgaaacgctttcaacaattgtgttgtactggaagaaaaggggtggagagatacgatggaattacagcaggacttgattcctcagaaaaaaacaatcggcgccttagatcacgccgtttttttatgcatggtattttgtttctggttttcaggctatatttacgttcctgtattcagtctgtatttggaggatctgcacttttcatatggcgcaatcggcatcattctcggcagctacggggtcacgcaaatccttctgcgattcccgctcggccttttgtcagacatcctgttttccttgcgcaagcaattgttaattgccgggttcggcttttccgtcctcagcagcctgctttttctgatgtttgattctttcttcttcgtgctggccgcccggcttttcgcgggaatcactgcttctacgtgggtgatggcgaccattttatacgcacattatttcaacaatggcaatgcatcaaaagcaatgggcatcatgcagttttttaccgtcatgcctcagtttgccagcattgtgttctgcgggctcgccgcagcccatttagggaggcaggttcctttttggatggcgctggcagcttctgccgcaggtctggtgatctgctgctttattcaggatccgtctgctcctcccgcaaaccgtggcaccattcgtgtcaatcagtacatcaaagatacattgcggctgccaaagctgaagcttttcaccatcctgtctatgacggcccatgccgtattatttatcacagtgtttggttttacgccgctttacatgaatcagctcggaatgggcgacgcggagcttctttgggtgatgagcgcctttttcctcccacacgcagccgccacattaagctttgtgtttctgcgctttacaagccgtatcgcttacttcgtgatgctcattagtttcgctgtcaccggggtctgtttgctatacgttcctttttcagctgcattgttcacggtttgcatcacacacgcctgtatcggactggcgctcggcttcgtttttcctctgctgctaagccatgtcgtcgaaatcagttctgcccgtttaaaaatgtcagtaatggggttttatcaatcattttatgcgctaggcatcttcctcgggccccttcttgccggaaaaatcgcacagcttgtcgggcttgcgggagttttttatggagccgggtctctggcatttgccgccttttttgtgatgctcgcgcaaaaacgtaacatgatcaattaatagcttttataccgccggaagcgccacacagaaaacacggccagaagcatgatgcacagaatggagaaagtgagtgaccatccgaaaaaatctgcccgctctccatgaagaaggatatgctccgcctgcttgcaaatctcagccggaagccacttcgcaccatctggaaataatgaaacagcaaaggaaacggctgctgtgagcccgatcccgcaagccgcagctgctccgacagaccggaatatcgtacttccggcaaggccggcggtcacaataaatatcacccaaagcgcgtaaaggccaaggcttgcggcaaagcggctgaatgatgcgtcctcaaacagcagccggacgtaatagtaagcaagcccgtatccagctgcaaacgacataatgccgatcacgctttggatgagccatttactcacgatataatgggctgccgtcacaggccgcgacataatcagcgctgttaccccttgatttctttcattggctacactgcccatcacgctaaagatgaccagagccatgccaagcgtgttgaattgagaaagcgtgctgaccatcacttcagacccggagggcatcgtaaaactgattttcatgccgtcaggaaggttccctccatgtgcgatgatttccggcatataataaatggtcagcggctgtgtcagcccgacgatcatcatcgcaatcggcagccaaatcagcttgccgcttttccatccttccagccactccttctgcaatagcgccatcatcaccttcatgcgtgcaccacctttagatagacgtcttctagagactccgttttctgttcaaagcgggtgacggtcaatccctttcggatacagtcacttaataatgaccggccagcgtgtatatcaggcagctcgaaaaccgcttgggacggattcttatagacaatagctgagacgtaaggcttctcttcaagccagccttccagcttctctttcactgaaagggtaaaaacgttcgtttgctgctgttgtttcagctcctgtaactcgcctttccatgaaatctcaccgtttttcataatcaccacttgatcacacacctgttctgcatcgtgcaaaacatgtgtagaaaacagaacggccatatgctttttcagctcccgcatcatgtccagcacctcgaaccgtcctgtcggatcaagcgcagacaccggttcatccaatatcaaaaacttcggtttatggagcagtgcctgtgccagaccgagtctttgtttcatgcctcctgaatagcccccgatctttttgtgcgccgcttcgtgcaaacccacaaattccagcatctcgccgatttcctcttggcattttctcttcgaaaggccggacagtctccccgcaaatgtcaaaaattcatttgcggtcatccaggaataaaaagctggatactgcgggaggtacccaatcaaacgccgatccggctttttttctcctaacagcttaatgtttccggaggttggcgaaagcagaccggccagcatttgcagagtcttggttttgccggctccattgggacctaatagcgcgacacactcgttttcattcacgtgaaaactgatattctttacagcttcatgatgcctgtacgatttgcataatgattcaatagacagcatatcggcttacctttgctttctgccgacggtgaaaaataaaatcggcccgataatattgatacatacgatgattgcagcccacatccactttggcccgttcgtccgctcttcttttatacagctgataagggcaaacaccgccaaagccagctgtaatacaatcagcggcaaaatcatttcccaagaaatattcattgcttgatcccccttttcttccgatccggcctaatgacaaaaaagtaataacaaatcagaggcatcggtgcttgaatcaatccgacaatcccccaaacccatgccatgtgattacgttttttcgcatcaataaataaaaagattccctgcgccaatacgatgagacaagccacaaccgttatgataatttctgtttgtgtcatccgcgtttcacctcgcattcgccgagatgcctttttttctcagccgcaatcaaaatcggcagcaccgcaagcacacaaacctgaagcacaataaacacagcaggagcttgagtgaaagctaagattgcagcactcacaaccatcagcgcgcagaatacaaataaaatgatctcttgaagaagtttttttctgtattcagctttcatttgtgacagctggtgaagcagttctttttgattcggtatagagggattggctgtttgatcaatttttttccattctgactttaaatgatcagaaagcttttctttattcatcatcccactcctttctgatttgctggagccctttatgaactctggactttacagtgccttctttgatttgaagcatcaccccgatttcagcgtaggtatagccgtagtaatgccttaataaaaccggtgtgcgcagtttagggtccagctttgaaaacagatcgagcgtttcgctccactctgcccctttcgccgacacgtcccacttgatcttgcggattgtttcctccgtaactgtctgattccgtttccattctctctttctctttttctggtgatcgagatagagccgcgatgcaatggagatcagccatgtggagaattttgaacggccctgaaagcttcttaaatggatgtaccctttcagaaaggtttcctgaacaagttcctcgctgagatcggggtgaagggaaagctttaacaagtatttatataagaaagaatagtgatagtggaaaagggctgtaaacgcctcgtcgtttccctctttcgcctgctggatcagccgctgttcttcatgtgtatccaatgaccgtgatccccccttttttgtttttctgccttatgagacgacaccggattcaaaagcgttcatcttttttacaattcttttcagccattgacagatcaggcttcccggccgtttggctgcatatccttatttgtaaaccctcttatagtctgttaagctatgactttatgtcgatttcaaaaaaacatccaatatggaggacgatgcattgaaagtagaaaggcgaacgattgaatatattccgaatgaagaaagacatggtaaagcgaaagatttatttcccgtatggttcggggctaatatgcatatcaccacgttagtgaccggcacgattcccgttgcaatgggacttaatctgttttggagtgttgccgctattatttgcggaaccttaatcggtgccatatttatggcgtctcattccgcgcaaggccctcagctaggcatcccgcaaatgattcaaagccgtgcccaattcggcgtaatcggagcgattcttcccctcttcttagtcatgtttatctaccttggtttcttcgcaagcagtacgattctggcggccggaaccttaagcagctttgttcccatcccgggatcatggagcattataggcttaagcgccgtatgttttttactcaccattttcggccatgatttgattcacaaaatgcaaaaaatcctttcttggacctcttttgctgtattttttgctgcaacgattctcatttttcaattgccgattccagcaggcagttggattcccggagcgattgatctgccaattttcttggtggcagtcagcgcagttgcgacgtggcagcttgcctacgcgccgtatgttgccgattattcaagatatctgccagttaaaacaccggcttcaaaaacattttggtacagctatgcaggtacatctgtcagctccatctggatgatgctgctcggcgcattgctgacaacctcacttcctgactttacggcaaactcaggcagccagattgtccaattgttcggtcccttctcgtttattatgctgatcattgtgttatttgggcaaatggcaatcaatgtttttaacctgtatggggccttcatgtccacgacaacaacgctggagccgtttctgaaattaaaagtcacgcccaaagtcagaatcatcatgatcctgggtgtcacgcttgtcggcacagtcttaagcctactgggacagagcaattttatggagctgtttttgaattttatctttttcatcagttatttcttaattccgtggacggcaatcaatttagtcgattactacttcgttcgccacggaaagtatcaagtcaaagccatgttcgacgtaaacgggccttatggaaaggtcaattggatcaccacaattgcgttcgttctgtctatcttgctggaaattccgtttatcaacacaagcttttacatcggaccgcttgccaaaatgtttggcggcggagacatcgcatggattatcggcttggccgtgccttctgtgctttactatgtattaatgaaaccgcgtctgaaaaaacgggcggggtatcaagaaaagctgtcttctctctgaagacagcttttttatcattcaaatcgtttccacacgcggggcaggatgtcagatagctcatgagcgagcaacgtatgagcggagtgctcgtccgtccagagctcggcgcacgcaccatgcaaatagaccgcgtttaatatggcgtgctttggatcttcatggcagcagagcatccccaatatcatgcccgtcagcgtgtcaccggttccgcccttggcgagcgccccgtttccggttggattgagccagcagtctccatcaggaaacgcgatgacggtttggtttccttttaacacaatgacagtctgtagctgagccgcccattcctttgcatattccgctctttttttctgcaattcgttcacgggcacccctgtcattcgggaaaactcgcccgggtgcggcgtgaggatgacgggggcctcccgtttcggatatgtgcgcttcgccagcgctccggcatccaaaataacaggacaatcagccgtaagcacatgatcgactgcctgctgtacgctttccgtttgcggaaggcccgatccgatggcaatggctcggtacgtctcttcaagctgagcatccgccgcctttttccagccgtcacgccaataggtcgcctcgggcaaaacaggaacaattagcgggattacgctttctgatgtaccgatgacaagcttgccgagaccgctccgcatggccccaagccctgcaagcagcgctgctcccggcatgtcgtcacttccagccagcagcaaagccgtaccgtacgtgcctttatggctctccgcatctctttcaggaagcgtggcccttacatgctcttccgtccaaaatggaacattcatctctatccctcctctgctttcttttcctatttttcctgtcccttttctttttcaaacaaaaaagacagccttttagggctgtcttttattttacaggaacatcaaggtgatacaggcggcgatatcgttcgtttgccgccagcagctcctcatgggttccttccatttctgttttgccgttttcgagaaatacgattttatcggctgcttccactcccgcgagatggtgtgtaatccataaaatcgtttttcctttcagcacctcaaacaccgtttccatcaattcacgttcggtaataggatcgaggccgactgttggctcatcgaggatgatgatcggtgtatcctgcagcaaaatcctcgcaagtgcgatccgctggcgctctccaccggaaaaacggatgccggtttcttgtacagaggtatgatatccgtcaggcaatgactcaatgtagtcatgcagcttgacctgctttgcggcgcggcgcacatcctcgtcgcttgcttctccgtttccgagcctgatgttgttcaaaatgcttgtatcaaacaggtgcggtttttgatttaacacggccaccgcatccgcaatctgatcctttaacagcgctgtctccactccgtttaacgtcacagaaccggagtccggtttcaaggcgccttcgattaatgcaagcgatgttgatttcccagagccgcttcggccgagcagcgccattttttctccttggcgcagcgtaaaggaaaagttgtgcagcacttggctgctgttgtcataagaaaacgtcacatcacgaaaggccaaggtgacatcttgaagatcgagaatttgatcccctgattcagtttgtgacgcctccggctgaggagccacattgttcatgcgtctgatagaatcctgatagcccggcacttcgcctaaggcatccgaaagcggcaaaaaggcttccgtcaacggaaacaccactagcacaaaagcggcaatcatcgttttagcgagatcgccgtccgcttgctgtcccgctgtccaaaacagcatcagcaaaataaggccagcgacaaggcattgcgcagcaaagtcccgccatcttgtaaagcgttgttttttccgttcaagctcaaaccaatcacgttcctctttttcataagcatcaataaaagcatgccggcgtccgctgaacatccagtcgctgacacccatcacagcatctgtcagacggctgtacagcacattccgtccgcttttcagcttcgcattcttcgctctcgtcacgagcaaagacacaaccggaaacaatacaacaagaacaaacaaatacagcgcaagcaatatggcaaacggccaagagaagaagccgagcgctatcactgacacagcatacaggagcaaggctgagatcgcaggaaaaatcgtttttaagaaagcatcctgcaaatgctcaatatcctcagacaaaatgccgagcatatcccccgtgcgaaaacgggaacgcagcatcaaagcacccggctcaagcatattgtaaaggcggacgcgcatgtcagatacgattttcaaaatgatgtgatggccgacgagccgttccacatatcgcgacacagagcgcgcaatcccaaaggtgcgcacagcgacaatcggcacataaatgagcagaatgttttccggccttgtcgccgctttagaaatcaaaaaacctgaggtgaacatgagaaaagcagcagaaaaaatcgtcaccgcacccaaaaagataaccagaacgaacaggcgggcattttgcttgatatacggcaaaatccattcttctttcttcatgctctttcccccagttgtgccttcacgagtttggtatacacaccgtttttctccagcagttcattgtgagtcccgatttccgcaaccctgcccccgtcaagcacgataatttcgtccatatcgagcatccagtgaaggcggtgagtcgcgagaaagacgagcttatcctcaaataaatccagcatcgtttcttttatttcatattctgtttcgatatcaagatgggcggtcggctcatccagcagcaggatcggacggtttcccaaaaaggcgcgggccagtgcgacacgctgtgcctggccgccgctgagcgcccggccgccttccccgatccgcccctctaatccttcaggaaggctatccaccagctccgccagtcccgccgcagcagcagcacgggctgtatcctctgccgaagcgcttggatggtagaagcgaatgttgttgccaagcgtatcatcaaaaatgtacggatgctgtggaatgtaaagaaggttcttctgccagctgccgtcctgcaaatgggaccggcttgtaccattaacctcaatcatcccgccatccggctctaaaaatccgccaagaatatcaattaatgttgattttccggcgccgcttgcaccgataataccgatttttttcttgcccttgaatgagagatgaatatcagacaccgaacggccgactgacacgcctgacagcttcagctcatcctgatcagaccaagcctcgagctgaagcggcgtctcttctttaaaaccaggctgcgacaaaatctcttgaatggtttttcctgcttcctggccgttcagcgttgcatgataatcattccccacttcccgcaccggcaaaaaatactcaggcgccagaataagcgccgttaaagcagggccaagcaaaatatcgccgtcaatgaggcgcaggcccagaaatactgcgactgtcgccaccgacagcatcgtgaaaaaatcgagggcgaatgatgacaaaaacgccacccggagtgtgctcatcgttgccttgcgataccgctcactcacatagaaaatatttttgctgtgtgacttgctcaaacctaggaaacgcaatgtctccagcccgcgaagagaatcaacaaaatgattggaaagtctctgataggatttccactgacgatccgcttttctctgcgcgacaaggccgaggagaatcataaagatgatcagaatcggcatagcagcgactaaaatgatggctgatgtccgatcctgaaaaaacacataaatgacaactgccgcaggcacaatcgccatgctgaccattttcggcagaaacagctccaggtagcggcggaactggctgatgccttccatcgccagcgtcaccatttgccccgtcccctctttctttgcaaagcgggggcctaatcggaacagctgatcaagaaaactttttctcaaatctgctcctgtccgggcggcgtattgatagacgattttctgtcgcgccaccgtcaccccgtgccgggcgataaaagcgatgaggaaaaagccgatcaccggaaaaagggaggtaatgcccttcccgttgaacagtccggttacggcctcactcagccactctgcctgcataataatggcggctgtctgaatcagcgttaaacaagtaatcacggtgagaatccgcttcattcctttatatcgaaacaggtcttttcccattaataagtcataggctccttatggctgacgcgcttccggaagacataatagctccagatctggctgccgatgacgaacggcaatagcgttaatgctgcaattgacatgactttaagcgaataatctccggaagaagcgttagctactgttaaatcgtatgcgctatgaagcgagctgaccattacgcgagggaatagggaaataaagatcattcccacggtcagcgccagaccagcgcctgtcatcccaaatgtccagccgtcttttttcttgcgaataaatacagccgcgagcataaagcagatgacaatcaaaagagcgagcggaatggtaatctcgccgcggcgtgtaaacatgtctgtctgatacgcagaaagggccgcgaaggcaagaaccgctacaaaaacaacacccattatcttttgcgccattttccgggcgcggttttgcaaatcaccaatcgtacgcagcgtgataaacattaatccatgctggaagcaaagaagtgttaccgtcacaccgccaagtatagaatatacattgatataatcagatacatgtgcgtgaatgttcatgtcggcatcaatcggcatcccgcggaataatgtcgtgaacagcacaccaagcacaaacggaggaatcagactgccgaagaaaacgacccagtcccaaacctttacccattttaaatgatccaccttgccgcggaactcaaacgcgaccccgcggcccattaacgcaagcagcactatgacaaacggaatgtaataaccgctcagcatcgttgcataccagtttgggaatgccgcgaaaatggcgcctgcgccagtcaaaagccacacttcattcgcgtcccagaacggccctatcgtgttgatcagcactctgcgttctaattcattatggccaagaaaacgggtcgccatgccgaccccgaaatcaaagccctccaaaaagaagaatcctacaaacaatacagcaacgagtataaaccaaagatcatgaagagatgccatggtatacctcctgactaaatggatctgttgatacaggcacatcatgatgattatcatgctccgcaccttttttaatctcacggataaacaagaagacaagcagtgcaccaagaatcatgtacatcacaccgaatgcgatgattgagaataacagggagcccgcagttacgttaggcgacacagattgagcggttgtcattaagcccatgaccgtccaaggctgacgcccgatttctgtcataatccagcccgcggagttcgcaagaaacgggaaggaaatcaaagcaatcatgatgcgcaaataccatttgctgttttcaagctttttgcggcggtttaaccaaaggccgcctaacgcagcaagaatcatgacaacacctgctcctaccatgatgcggaagctccagaatgtcgttttcactggcggaatgtagtcgccttttccgtatattttttcgtactcagcctgaagggttttcatccctttgacacttccgctgaatttctgataagccaagtagctcaaggcataaggaactttgatttcgtttgagcttttttcattttttgtatcgatcgtcgcaaaagcggtccaagcagcagggtcaccgctgtcttcccataggccttcactggcagccattttcatcggctgtgattccatcaagtgctcagcctgcatgtgtccgctaaggccgacgccaagaccggcacaaaggccgacgatcattgcgagtttaaaagattgcttaaagaacggcacttcttttttcttcagcagtttaaaagcactcactccggcaataaagaaagctccagtggcaagcgcaccgaaaatgacgtgcgggaattcaacccaaagctgagggtttgtaatcaacgcgccaaaatcattcatttccgcgcggccgtttttgatcgtaaagccgaccggctcctgcataaaggagtttgctgttaaaatccagaaagatgacatgatcgttccgaatgatacgagccatatgcagagagcgtgaattttcttcggcaggcggtcccagccaaaaatccataatccgataaaaatagactccatgaaaaacgccaataatgcttcaatcgcaagcggcgcaccaaatacatctccgacaaaacgggagtaatcagaccagttcagtccaaactggaattcttgcaaaatccctgttacaacaccgactgcgaaatttattaagaataagtgtccccaaaactttgccattttgagatacagctcatttttctttacaagataaagagtctccatcaacgcaaccataaacacaagcccgatagacatcggcacaaacaagaagtgaaacaacgttgttgatgcaaattgtatgcgggctaataccaattcactcatgctttctcctccatttctggttaaaactgtaatttgctcactacttcacaagtagaaccgagactttgatcagtaattcacaaaatagatgaaaaaaatattgctcaatatttcacaaatgtgtcaaaaagtcgtccaatatgaggcaagattgccagactgaccaaatgacacaacctctgactggttcatattaagtactttacaacgattcatttcaaaaataaagcctaaaatacctaaaaagtcccgcactatgtgacggatttttgtctattttgttgcttatttatgtcggctgctaggataaatgaccctttattatcgtacatcaacacatcgttccttgcgaacaaaatgcttgcccccgccccagcactcgagtctcagcattccgtcttaaaccgattttagtcagaatgcctcttttcatttgaaccggtaagaggagaaaagttgaatagtaaatttttaatatattaataatttcaattttttagtatacttaacatagtgaacaatttcactgcatcaagaataggggaggtttttcaatgggagagcttcaaacacacatgcaattgcaaacggatacaattcacgaaggggttcgaaaagagaattggtttgcgaaagccatgaatataaaagtaggcatcataccgcttcctgtgtatgccttgctgtttatattaatcactgtttttgttatgcatcacgatgtaaaaagtgacattttgacatccattgccgtcatggcgtttttcgggtttacctttgcccaaatcggcaaatcgataccgattgttcgttctatcggcggcccggccatcctagctacttttattccgtccgctgtcgtgtactatcaccttctgcctaatgatatcgtcaaatccaccacagaatttacagaaaactcaaactttctatatttgtttatcgccggcattgtcgttggaagcatcctcggcatgaaaagagaaacactcgtaaaagcatttatgaaaatctttattccgcttattgtcggttctgtcacagccgctattgtcggactggctgtcgggacattgctcggactcggatttcagcataccctgctgtacattgtcattccgatcatggctggaggagtaggagaaggcgctataccgctgtccatcggatattctgacatcatgcccatttctcaaggggaagcgtttgcacttgttctgccatcgattatgctgggcagcttgtgcgcgattattctagcgggattgctgaaccgaatcggaaagaaaaaaccggaatggacaggcaacggcaaagtggaccgctccgaagaagagtcccctgcgctggaggaatcacaaagcggacaacaaatgttcaacctttctttatttgcgtcaggcggtatccttgctgtttctttatacttagtcggcatgctcgctcacgattttttcggttttccggcacccgttgccatgctgttactggctgttctaatcaagctgttcagattggtgcctgcctcaattgaaaatggcgcgtttggagtgtcccgctttttttcaacagctgtgacctacccgcttctctttgcgattggggtatccatgacgccgtgggacaagcttgtcgccgcttttaacctcagtaatattattacgattctgtctgtcgttgtgaccatgatggccgttggcttcttcactggaaaatggctgaacatgtatccgattgaaaccgccattatcaatgcgtgccattctggacaaggcggtacgggtgacgttgccattttaagcgccgctgaaaggcttgagttgatgccgttcgcccaggtatctacccgcatcgggggagcgatcacagtatccttaaccttattgctgctgcaccagttttattgatccccgcaagcaagttcttcgtcaaacgaaagagcttgcttttttgcatgtccatatttttgcaagttcccatcccatgctatagtaatagttggaaatactagatagaaaggaatctggcatgcctatgggaactcatctatttctctttatgcttctcgggctgggattttatttgatatcagccctagctgcaaaactcattccggccatagacttctggattgatattgttctatgggtcggcgctgcagtttacatcttctctcatctctcattcatggacggcattgtctcactcgcgacaatgttctactgctattggaccgcaatggatctcattgtttcagagcgtgtggaaaaaccttcgggagactggcaggaaatcgagctggccagaaacaaaacacgtctcctgtcagacattacgctgaccgccattgtgtttgcaggggctgttatttttttcatctatggacctgacccaagccctctcaaatatgtgatccttctcggcatgatctccggcggaggggcactggtgaagcgtatactgaatgttttcagcgtaaaggttttttattcagcagccttagaaaaattgcatatcagctcacactatgaaacccgtacatacccgctttccgatttgaaggacattcagcttgaatcaacagctgatctcttaaagctccatccgcttctgacgatgtattcatcacgtttagatttgacaacaagctttcagcaagtcattaaactgtctcttcccggcgaaacactgtttctgacggtgaaggaaccgcaaaaatggaaaacaattcttcaggaatacacagatgcaaaaaacaatgtggacaatgtgatttctgttttgccgttttatcatagaaaaaatgtgaagcggctgctcgggaagctttattttgccgccagcgtaaaaggggtatccgcttacgccttattggtgctcgcgttatacgcatcacacgcctctccatgggtcatggctgttgccgtaatcctatattgggtattcaacatgtatatgtcagaccgtgtgttgcgggcagcgatggacgccaagccttgtcatcatccgcatgtacaggcagcggccgatatgattttccgatcggccggcatttcccatgtccgcatatacgaaacggagagtgatgattacaacggaatggcagtaggcatgaatgtcgggaggtcaatggtcatcctgacaagcgccacactaacacttccacagcgtgtcatcgaaggcattctggcccatgaggcaattcatatcaaaaaacgtgacgttctgtcatcacagcttttgcgttttctatatcttggagctgtcgttgggattttcctcttgtttgagcagcatatcacccatcccgaggcccacaaaattgcgctttgggctttcattatggcaatcattatcctattccagctctatcaatccttttgttcacaatggatggaggtgcgtgctgacaaccttggcgcatccttgctggagggcggttacaaacaaatggctgaagccttgaaaatcttggcggttcagcaggatgaggacatacagaaacaaagtgcctacagctctgaagccggtgaagacgagcttcaaattgactctctcacccgtgataaaagctggtttttcagattgattgattttcagttcgctcctcatccccctatgtattggcgtgtcggcactttattgtcaaacaaaggacatggggtgctaaagcgctggctcagagaccgcctgaaagaatcaatcactttgaaatgaaaccggtcagcgtttcatccgtataacagatatggtgaaaaaagggagtgaccagaagtgatagtgatcttattgataatagctattattgtttttctttcagtcattcagccgcagccatcggataataaaatccgccagcaggcggacagcgggtatttcggttattcagatcatagctcgcaccatgatggattcggcagtgacggaggtttcagcgattccggctgtggcggcggagggggcggcgattaaacgccgcctttttttatttcattgattcgatgtacgcaccaaaagccgagcccgacatgcctggggacacgcgcacacgatggagggcatacattccctggtctctcgaagccgcgcccggttctgtcgtcacgcccatttgatagcctgttttttcagcggccttcagcgtctcctcattgtagcgccctaccggatagctgatgatggtggtttgctgatgaaacatgtggtcgaacagctttttcgaatcagccatctcgctttgctgctgttgaggcgttaatccgttcagctcaacgtggtcaatcgtatggctttcaatcgatatgccgtgctgtgccatttccttcatttgttcctctgtcagatggtgcctatgtccgatcgatttgccgatcataaaaatcgttgccttcatcccgtactttttcagcaccggatacgcatcttgataattgtcggtgtacccgtcatcaaatgtgatcagcacgcacttctcactcggttttttatcctgcgtcagcatgagatatgcctctttcggcgttaatgtctgatagccgttatcatgaagccacttcatatgcgcctcgaattctttctttggcacacggaggctgtttcctgaagaaatgctgtggtacatcaaaatcggcagctttgccggtttctctgttttgatccatgcggatgtatcgtcttcttttttctgaacttgtactgcctttttttccggtttcttttgttccgcttttggcatcggctgctctgcattcgcctcttgatcagcgcaagccgcaagagccaaacagctgcccaaaagaaagatgcttaaaaacaatcgtttcatcgttctcctgctttctgtctatttcttcctcctttttcatcggtttgattctgaaattttcaatagcaaaaaaccggacatgtctccatgtccggttttttgatcttatcggattctcacttctgtctcactgtcaaagaaatgacctttattcatatcaaatgcgaccgtcagctcatcgcccgattgaatatcgaggcgggcgtcgatccgcgcaataaagtcttggttgtcgatctgcgaataaatcatgatttcagaaccgagcagctctgcaacattgattttggccttaatcgaagagttcttatatgattccacgacaatcaattcatcatgtatatcctcaggacggatgccgaagatgacctctttgccgatgtagcctttttcacgcagcactttcatttttccttccgggacggttaatgccgcagaaccgattttgattaagccatccgtgagcttccctttgaaaaagttcatcgctggtgatccgataaacccgccgacaaagacgttttcagggaactcgtatacatccttcggcgtcccgatctgctgaattttcccatctttcatgactacgatccgtgtcgccatcgttagcgcttctgtctggtcatgtgtcacataaatcgtagtagtctgcagtctctggtggagcttaatgatttccgcccgcatttgcaccctcagcttcgcgtccaggtttgacaaaggctcatccatcaggaacacctttgcatcccgcacgattgcccggcccagcgcaacccgctgtctctgtccgcctgacagcgctttcggtttacggtgcaaatattcctccagcccgagaattttagcggcttcttcgactctttttttgatttcaggcttcggcattttccgaagcttgagcccgaacgcgatattatcgtagaccgtcatatgcggatagagcgcgtagttctgaaataccatcgcgatatccctgtcctttggcgctacatcattgacccgttttccttcaatataaaaatcgcctttcgaaatttcttcaagtcctgcgaccattcgcagcgtcgttgatttcccgcagccggacgggccgacgaatacgataaattccttatcggcaatatgaaggttaaagtcatcaaccgccggttccttttgatcataaaatttataaatatgctccatccgcaattcagccatctaacatccccctttgttattgtaaacgctttcttatattaagtgtaacagcaattccctctcgctaaaatgggcagcgttcataaaatcacccagccatttttcgtgcatatttccaatttattctgaactttcattttgcaggcagataaaataggcaagaagcgcgcctttgtacgatttgatatctatccctgaccgctcaataaatttatcaatccgatattgcaggctgttgcgatgcagatgcagctttttcgctgttaatgtgacgtttgagttgttttcaataaacagcttaatggtcttccttagctcagcttcacttccaaataaaagctcagcttcttcagagagcagcgtttccagtttttctttttctgtttctaataatagaaaaggaaagatcatctcaaaggtcacactctgcacctgaggcagccgtttttcagcaaacaggaaatacgcctgttcacgagcataatgttttcgcagacactcatccggctcgtaaaatcttccggcgtaaaaacggacactgaagtagaaatcactttcaagaacctttgcgagcgattccagttcgcccttctccgccgccgcttcactttcctgctcgacaatcacgcctctgtcctcatggatccacacaatcacaaaagacaccggccaaaaatggcgaaccgcttccgtaaaggacgtcctttctattttgccgaacaaatgaaagtgaacaaatctcgtccgtttctttatgtacgccggcaattcccctctggaaaaaaggaacgaaaaccacttgttttcctcaggtgatttcatagacatttgattgccctcatccgcaggcgtcaaaaatgcctgcagcaccaatacttctttttcactgatctctgttttcggaatggagatatatctctgattgctctcatcaaaaaaacatagacagccttcccttatgcaaagctcctcagacacaatcgaaccgggataaatagccagcagcgatttcatagagtctcctctcttatgtaaggatctgtatattcagtataaggcgaaacacacatgttctccactaaaaaagagtatatccggtatagatagacgagaaactgaaagggaaacctcattcgtttacatattggcttcagcggaaatagaagaagacatgcaggaccaaaggagggtcatcttatgagtttcgaaacgttaaacaaaagttttatcaacggaaaatggactgggggagaaagcggacgtacggaggacattttgaatccgtatgaccagtctgtgatcacaacagcatctttggcaacgggcaaacagcttgaggatgcgtttgacattgcacagaaagcccaaaaagagtgggccaagagcacgacggaagaccgaaaagccgtgctgcaaaaagcgcgcggctatttacacgaaaaccgtgatgacatcattatgatgatcgcccgcgaaactggcggaacgatcattaaatcaacaatcgagctggaacaaacgattgcgattttagatgaagccatgacgtatactggtgaattaggcggcgtcaaagaggtgccatccgacattgaagggaaaaccaataagatttaccgccttccgctaggtgtcatttcatcgatttctccatttaatttcccaatgaatctatccatgagatccattgcgcccgcaattgcgctgggtaacagcgttgttcacaagcctgatatccaaactgctatttccggcgggaccatcattgcgaaagcgtttgaacacgccggtcttcctgccggtgtccttaacgtcatgctgacggatgtaaaggaaatcggggacggcatgctcaccaatccaatcccgagattaatcagctttacagggtcaacagcagtcgggcgccacatcggtgaaatcgccggtcgcgccttcaaacgaatggcacttgagctcggcggcaacaatccatttgccgttctttcagatgcggatgtcgatcgtgctgtggatgccgcgattttcggaaaatttattcaccagggacaaatctgtatgattatcaacaggatcatcgttcatcaagatgtatacgatgagtttgtagaaaaattcaccgcccgtgtcaaacagcttccgtacggcgatcaaaccgatccgaaaaccgttgtcggcccgctgatcaacgagcgccaaatcaagaaagcactggagatcattgagcaggcaaagacagacggcattgagcttgcggttgaaggaaaacgcgtcggaaacgtgctgacgccgtacgtctttgtcggtgcggacaacaacagcaaaattgcccaaacggagctgtttgccccaatcgcaaccattattaaagctggcagcgaccaggaagcgattgacatggcaaatgatactgaatacggcctcagctctgcggttttcacttctgatttagaaaaaggcgaaaagttcgccctgcaaattgacagcggcatgacccatgtcaacgaccagtccgtcaatgattcgccgaatattgcctttggcggaaacaaagcaagcggtgtcggccgtttcggcaatccgtgggtcgtcgaggaatttaccgtgacgaaatggatttcgatacagaagcaataccgcaaatatccgttctaaatgaaaaaatccctctgtttcaagtacagagggatttttctttatttagatatatccacaaacccttcgccaaacacatcgcgtacgtcatgtacgatcacaaacgcttttttgtcgcagcttctaatgatttttttcagcatagacagctcctgtttgttaatgacgatatacaaaatctcttttgactggcccgtataatttcccttccctgataaaatcgtcacgccccgatccatcaaggtatttacctgctctgcaatctcactcttattttctgaaatgaccgtaatggcttttttcgtattcaaaccttcaataatgaagtccatcactttggtaccgatatacagcatcacgatcgtaaacatcattttttctgcaccaataataaaataagagctgaatactacgattaaatcaaaaaacaagagtgcatagctgatattccagtctaaatatttattagcaattctggccaaaattgcggaaccggctgtcgtcccgccgacccggataatcatgccgatcccgactcccgcaaatacacctgcgaaaatcgcattaatgatcaattcatcagacggaatgctccacccatgtgtcagatgaagaaaaagcgaatttgccgcaaccgcaatgatcgtataaaccgttgtttttccatccagaaacttgtagccgattaaaagcaaaaacgcatttaagataaagttcgtgacaccaggagaccattgaaacagataatacaatatcagcgtaatcccagtgactccgccttccccaagatcattgggaatcgcaaataaattaaccgcaagcgcgaagaaaaaagcgccaatcacaagcataagtacatccagcattctctttttcatcacgaaaacactccttttcattgttctgttctagcaaataaaaaaacccaggagaacgctctcgaaaaagagcagaaactcctgggcttttatcccaccgtgtcataacagccaaactgctatgtgttttctctcggtcacagtccaatttgcattgcggaaccctagaaaaccactgtttttatcatatccttttcactttccaatattagcattataagggacggttcgaattggttcaaggggtatttgcggagttttcatcagataagctggaagaaaaaatgatttatctattaaaaaagaacagatataaccgataagaaaaaaagcatatattttacaagtaaatttaactataaatgataataattatgagaaattcataattttatattgactaagtgaaataatataggcattatagtacatatgtttcgtacattttattacataggaggaaatataatggcaggaaaactagtaccctgtaaagcttgcggtcaagaaattgcaaagggtgtaaaaaaatgtcctaactgcggtaaggatcaacgtaacttttttatgcgacataaaatcattacgtttattctcgcagttgttgtcatcattattatcggtaatatgattggcggaggcggttcagaagccacttccaaaacatcaagcagcagcaaagcagaaactgaaaaaacatacaatatcggtgatactgtaaaaactgaaaaaactgaagtgacagttacgaaggtagaggacagagatactgtcggtactcaatatgttgaaaagaaagcatctgagggaggtactattgtagctgttcaatatacaattaaaaacgtatctaaaaaaccgattagctctttttcaattccaactgttaaattagttgatgctgatggtacttcttatgattctgatattgatgcttctgtaaactatgcaactgagacaaaagttgataactctaaaattttgagtgatctaaatcctaatattaaagtaacaggtgtaaaagcatttgaagttgacaaggaagcttatgcaaaaggcacttggaaactaaaattcagtaatgatgttattgtgaaaatcaaataacagctaaaaagggtgcctgttcaggcacccttgttctttaaaggccttctctattgagaaggcctccattcttattccgcactcttatacccattcacattagaagactgccatctccaggaatcagcacacatttcctcaaggccgcgtttcgcttcccagcccagttcccgcttggctttcgcaggatctgcaaagcatgtggcgatgtctcccggacggcggtccgcaaaacggtacggaacctctttccctgacactttttcaaaggctttgaccatttcaagcacgctgtagcctgtgcctgttccaaggttgtatgcatcggctcctgtagagttcaatactttttccaacgccttaacgtggccttctgcgagatcaacgacgtgaatataatcacgtacgcctgtcccgtcttttgtcggatagtcatttccgaatacgcttaattgctcgagcttcccgactgctacctgtgccacatacggcataaggttatttgggattccgttcgggtcttcaccgatccgtccgcttggatgcgcgccgaacgggttaaagtaacgaagcagcgcaacgctccactcattgtcggctgtatgcaaatcacgcaatatttgttcaagcatgagcttcgtctgcccataaggatttgtcgcgcctaatggaaagtcttccgtaatcggcgatgtttccggaacgccgtacactgtcgcagatgaactgaatacgattttcttgacgccgaatttctccatggcctcgcataaaataaacgttcctgtcagattgttatgataatatttgagcggaatcgccacagattcaccgactgcttttaaccctgcaaaatgaatcacagcttcgatttcattttcagcaaaaaccgcatctaccgcttcccggtccaataaatctgcttcgtagaacgttaaatcttttcccgtaatctccttgacacggttcagcgcctcagccgaactgttggacagattatcaagaacaacaatctcgtatccgctgttcaataattcaacacatgtgtggctgccaatgtacccggccccgccagtaacaagtattgccatgatgtaaccctcctaaaaaatgacctgttttcattatatagtgtttaaaaccggtccacatccatttttaagaagtttaatcgtttattaatagttttttcatatattatcagcattttcatacctttatgcagcgtgaacaagtatagcagctgaaaaatcaatctgccggttgacgtttttctttcctattttcgctatgcttaatgcagaaaggatttgatgacatggcgatgagcccttatatttttattgtattgattcttattattttatcgatgtatcgagaaagaacggtaaagcccgggaagttgctgatcattccgctgctgctcttatggggcgtatcagcatcgtttcagccggcgtattttcattccgtattacatgtggcgatcagcggcattttattactgatcgggctggcctgcgggtttggcattgggaagatggtaaatgtgcggattcacccggaaacaggaaaggtcacttcacgcggctcacttgggagtgttatcctcattctagtgatactttctttgcgcatagccgcgagaacatggctgcctgagagcaacgagatgtttattgccattattcattctatgttcttcgttcccctaggcaccattacagcccgtaacatcatgctttacaaagcatacagacggctgaccgccggcaaagtatccattcaataaccgaaagaaggaccagcatgaacggacaatctccggctcggcattactacaagaagcttgtgccgagccttattctcattttgaattgcatacaatttttatctcatccaactaaggctgatcccattttgttagcatttgtatttgcggtatacttagcattcatttggatcattccctatgtggcatccgctgctgttagtttgagcatattcatcggactttggctcctgaccgatttcttttgggctgtttccggccaagagcagagtgccgcctattttttgattgtatttttaatgatatatgccgcctttagactcccttcacggctatccttgatcttcacagcatgtttaattggaggcaacatattactcctatcctcacaagggggaagcttgaataccatcattagcaacatctcgatcatgctcgggctgtacgtcctcttctcctccatgcgtttcagacgagaagcgagaagggaggctgaacggaatcatgctgaattggcaaaaatgcatgtgcagctggaacatgctcataaagaactccagaaagcgcatgcagagctgcaggaggcttctgttctttcattaaggtacgcggtccttgaggaacgtacaagaattgcccgcgacattcatgacagcatcggtcacgagctgacttctgtgattgttcagcttcaatcccttccctatatccttaaaagcagcaaggaggattcagaaaaagtcattcaaaatgtactgagtgtcgccagggaatgtcttcaagaagtgcggtctgtcgttcaccaaatgggccgtagtgaatcgatggtggggcttaccgctttgcgggggctcattcatcaagtggaggaacggagcggcttgcacgtttctttagatactgccggactgtcagaagagtcttggcctccaaacgtgagcgaaacgatctaccgcatcttgcaggaagcgctgaccaatatcattcgtcacgctgacgcttctcatgcggcggccgtcatttctaatgacaagtcccatctctatgtcacaatcaccgacgacggacaattcaccggcagccttacttatggatttggcctgacaggaatgaaagagcgcgcagaaaaagcaggcggttcccttactttcagtgccgtacagccgagcggcctgaaaattgagctgtcattgccgctcatgacaacgcataaggagcaaaaagatgaacaaagataacatacgcgtcgcgcttgccgatgatcagccgcttgtgcgtgaaggcttccgctacatcatcaacgcacagccggatatgacggtttctggcgaggccggcgacggtcaggatattatagcactcgcaaaacaaacaaaacccgatgtcatcctcatggatgtccagatgccgcattgctcaggcatcgaagcggcgaaagacattatgtccgcacttccagatacaaagatagtcattttaaccacctttgacacggaagaattcgtatttgaaggcatccgtgcgggcgcagtcggctatctgctgaaggatacacttcctgaagagctgatagatgcgattcgcgctgcggcgagaggcgaggcgattttccgtacagtcacagctgctaaaattatcagtgagacatttcgagcgaagcaacagccttatgccgaagaactggcagagccgttcaccaaaagagagcttgaggttcttcagcaaatggcctacggactgagaaatgaggatattgctgaaaagcttttcgtcagtgaaagcactgtgaaaacccacgtgcaccgcatcctgcaaaaatgcaatgcccaagaccggacacaggcagtcgtttttgccattcgaaacggtattgtgcaatagaaatctctcatcccgccatgctaaaataagacaaaggagatgattggaaatgaaagaagaaatcattgaacggtttactacatatgtaaaagtcgacacacagtccgatgaatccgttgagaattgtccttccacacccggccaattgacattaggaaacatgctcgttgatgaattgaagtccatcggcatgcaggatgcagccattgatgaaaacggctatgtcatggcaactcttccctccaatactgaaaaagacgtgccgacaatcggctttctcgctcacgtcgacaccgctacagactttaccggcaaaaacgtgaatccgcaaatcatcgaaagctatgatggaaaagacatcgttcttaacgaacagctgcaggtcactctgtcacctgatcaattccctgagctgtctggctataagggccatacactcatcaccacagacggcaccacccttctcggcgcagacaataaggccggtatcgctgaaatcatgacagccatggattacctcatcaaacaccctgagatcaagcacggcacaatcagagtcgcctttacgcctgatgaagaaatcggaagagggccgcacaaatttgatgtgaaacggttcaatgcatcctttgcctacacggttgacggcggcccgctcggcgagcttgaatatgaaagcttcaatgccgctgccgcaaaaattacgattaaaggcaacaacgtacatcccggaacagctaaagggaaaatgatcaactctgcgaaaatcgcgatgaagctgaacagcctgctgccggcagacgaagcgcctgagtatacggaaggctatgaaggcttctaccacctgctgtcgattcaaggagacgtagaggaaacaaagctccactacattattagagactttgacaaagagaatttccaaaacagaaaagaaacaatgaagcgtgccgttgaagaacttcaaaacgaatacgggcaagaccggattctgttggatatgaacgaccaatactacaacatgagagagaaaattgaacctgtcatcgaaatcgtcaacattgcaaagcaagcgatggaaaacctcggcatcgaaccgaagatttcccccatccgcggcggcaccgacggatcgcagctatcctacatggggcttccgacgccaaacatctttaccggcggggaaaacttccacggcaaatttgaatacatctcagttgataacatggtcaaagccgtaaatgtcatcgttgagatcgcaaagcagtttgaagcgcaagcataatgccaaaagccagtccaaaaaaggactggtttttttgtgtgaaaatgaaacattttaaacgcgtcctccgtaaaacaagtatcaacaaatgaggaggaaaaacaatgacaaaacatgcaatcgccgcaaagagtctcttgaaaaaatggatcatttccaggccgcttaacatgcaaaagaaatccagcccatttcaaaaaatcagaaaaatgttcaaacgcttcttcaaataaaacattcaaatccccaaaattcaattcacccgtaccgcccaaatgctccgtaatttgggttttttgtgttcaattccgcaaaatagggtataaaccaaacaagcaagaaaacagcacccaaaaacaggtaattcgaattacgtaaacttaggttaaaagttgtataaaggaatttattttatcgtcgatagtaactatagaaccaatcatcaacaagagcaaacagcgtaattcaagactattttcaggtcatcaggtaatactgttttagagggacagtttcttattatttattgatttagaattttttgaatactttttggcattttatccgtacaatagagagtaccaaaactttttttgggaggtatgtaatatgatcctatttattatcatcgcattatgcggctatcttcttttttctttcagcaaggacaatcgccgcaaaccgcaaaagacaagccctctgccagcagccgcacctcatcacaacaacctaatcgaccttgacgccatccgccaaaaacgccggatgcatctttcctaattctatatttcaaacgaaaaggctgctgaatcacgcagccttttaaaattggtttgatttagagcctgaaaccttttcgccacctatccgtaatttcatacaaggcaaacccaaaggagacttcagcaatgatcgagttatttatgaaacaaaaaatgttctcatttaaagatgcatttcacatttatgaccgggatgaacaagaaacattcaaggtggaggggcgttttttctcgttaggagactcattacaaatgacagactcatctgggaaaacgctcgtttccatagaacaaaaactaatgtctttattgccgcgctatgagatttcaattggcgggaaaacagtttgtgaggtaacgaagaaagtaacgtttttcaaaccgaaatttgtgatttccgggcttaactgggaaatcgatggtgatttatggagggatgaattccagctgacggacggggaaaatgtccggatgtcagtgagcaaaaagtggctcagttggggtgattcctatcacttgcagattgcaaacgagggagatgttctgatttgcactgccatcgctatcgtgcttgatatggttttatataacgatgaagatgaaagtattttctaaaaagcattgacaattgatccaaaagtaataatattaagataattgaaatctgaatatgaagttgtaccttatcaagagaggtggagggactggccctatgatacccggcaaccgctgtttcaaacagaatggtgctaaatccttaagaacattgcgttcttgcagatgaggcggagatttgatcgttcaagctcttccttacacaaaggaagagctttttacatgctcaatatttcagaaaagaggcgaataacatggctcaacaaacgaatgttgcaggacaaaaaacagaaaaacaacgcaaagcacctttccgcgccgatcatgtcggcagtttgcttcgttccgttccggtgaaggaatcccggcaaaaaaaagcggctggtgagatgacagcggaacagcttcgtgatatcgaaaatcaagagatcacccgcatcgtggaaaaacaaaaagaaatcggtctcgatgtggtaacagacggggaattccgacgttcctggtggcattatgacttcctggaagggcttgacggtgtggaaccgttcatcccggctgagggaattcagttccataacacaaaaacgaaagcgcgcagcatcaaagtgacgggaaaactcgattttacgagccacccagcgcttgctgattatcaatttttacatgagattgctggtaacgcgacgccaaaattgaccattcccagcccaaatatgctgttttttggcgaaaaggcggataaagggatttatgacgatcaagaggaatactttcatgatctggcccaagcgtacaaaaaagcaatcaaagccttctatgatgctggctgccgttatctccagctcgatgatacgtcatggtctctcttctttgaggaaaaaggcagagaggttgtccgggcgctcggcggcgatccagaaacattgccagccatatttgccaaaacaattaacgatgccgtcgcagaccggcctgacgatttaacgatcacaatgcacatttgccgcggcaacttccgctcaacctgggcggcatcaggagggtacgacgctgtagcggaaacgattttggacggcttaaaccttgacggccttttcttggaatacgatgatgaccgctccggaaactttgatccgctccgttttgtgaagcgcaaggatctgcaaattgtgctcggcttgatcacatcgaaatacggcgagcttgaaaatcctgaggatgtgaaacgccgtatcaatgaagccgcgcgttttgtcagcttggaccagctatgcctgagcccgcagtgcggtttcgcctctacagaagaaggcaaccttctgacagaggagcagcaatgggcaaagcttcgccatgtcatcgacattgccaacgatgtgtggagataatctatcattgacagaaatagaaaatgtgtgaataatagatactatcagaaaatttcataaaaaggttttccttatcaagagaggtggagggactggccctgcgatacccggcaaccgctgtttaacagaatggtgctaaatcctttagagcaatgattgctcttgaagataaggttgagattgtcacgcaagctcttccttatccaaaggaagagcttttttacatttgaatggaaagaaggaatggacaacatgtcacaacaaacaacacccgcagaacaaaaatcacttcaaagaaaaaaaccgccgtttcgcgcggatcaagtcggaagcctgctaagatctgagcccgtcaaaaaagcgcggctgcaaaaagcggccggcgaaattaccgctgagcagcttcgccaaattgaaaacgacgaaatcatccgcattgtggaaaaacagaaggaaaccggcctgaacgtcgtgacagacggtgaattccgcagagcatggtggcactttgatttcctggaaaacttagatggcgttgagccgtttactcctgagcaaggcattcaattccataacgtacagacaaaagcacgcggcattaaagtcacaggcgatatcgacttttcaactcacccaatgcttgaagattactcatttctccatagcattgccggtgacgcgacgccaaagatgaccattccaagcccgaatatgctgtttttccgcgggaaattggaaaaaggtgcatacaaaaacgactatcaccttttccagcatgatgtatccaaagcatataaaaaagcgattcaagcgttttatgacagaggctgccgctacctccagcttgatgatacagcgtgggccgttttcttatcagaaaaaggcttaaaacaaatcgaagcgttcggaacaacgcctgatgagcttcgccagctgtttgcgaaatcgattaacgacgcgattgcagaccgtccggatgacttgacggtaaccatgcatatttgccgcggcaacttccagtccacttggacagcggaaggcggctatgacgcagcagccgaaaccatttttgatggcttgaatcttgacggacttttcttagagtatgatgattcacgctcaggcggatttgagccactccgttacgtaaaacggtctgatcttcagcttgttcttggcttagtgacatctaaattcggcgagcttgaaaatccggatgacgtgaaacgccgtatcgaagaagcgtcccgttatgtaagcttagaccagctttgcctcagccctcaatgcggattcgcttcaactgaggaaggcaacaagctgactgaagaacagcaatgggcgaagctccgccatgttgttgagatcgctaatgaagtttggaaataagcaaagaaaaaacacacttgattccctagcggagcaagtgtgttttttatgtcattgtgcggtgtagcccccatcaaggacgacagcctgcccagtgacgcccttcgccttctcgcttgccaaaaacacggcataatccgcaatttccttgacggaaagcagtcgcttttgcggcacaagcggaaaaatgacttgttcaagtacagagtcgtaagggacatttctagttttcgatagatcgctaagctgattgcgtacaagctgggtatcgacataacccggacagagcgcattgactgttatgccgtggggcgcgccttccagcgcccctacttttgtgagtccaatgacgccgtgcttggcgctattataagcggatttccctgcaaagccgactaatccattaacagacgcgatattaatgattctgccaaactgctgttttttcatgatcggaaaaacatgcttcattgcaataaagggggccgtcagcatgaccttgatcagctgttcaaaggtgtctgtcggaaactcttcaatcggagcgacgtgctgaataccggcattgttcaccagaatatccaagcggccgtattgtttttggatgacgttcaccgtatcagcaacttgcgcttcctttgtcacatcatacggaatggccgccgcgtcaaagccttcttctgcaagcttggaggctgctttttcacatgcttccggacggaggtctgaaacgatgacgctggcaccttcccgggcgaattctcttgcgatttcgaatccgattccgccggcagcccctgtcaccaaagcgacttgttttctcatgtcaaacaccttcccattaagaattgagtacagactggcttacagcgaaatcagcttctgttttttcataaacctcttcaattgtgacaccatcctgaagctccgtcagtgtcatgcggccgttcacaaaatcaaatacagccaaatccgtaatcagcctgtgcacgactttctggcctgtcagcggaagggagcatgtttttttcacctttgattcaccatgcttattgacgtgctccatgatgacaacgattcgtttcgccccgttgacgagatccatggcgccgcccatcccttttaccattttgcccgggatcatccaattggccaaatccccctgctccgaaacctccattccgccgagaatagccaaatcgatatgcccgcctcttatcatcgcgaatgactcagcgctgtcaaaataagaggcgccggtcacttcagtgatcgtttcctttcccgcattgatcaaatccgcgtcttccgttccttccagaggataggggccaattccgagcaagccgttttccgactgaagcatgacgtgaacgccatcgggtatctcatttgcgacaagcgtcggcatgccaatcccgagattcacattcatgccgtccttgatttcttgtacagcccgtttgaccattcgttttctcgcttccttcacttggcctcaccctttcccgatgcttgctgaactgttcgtttttcaatccgtttttcttggctcgcgccaagcacgacatgctgtacgtaaattcccggcgtatggatgtgatctggatcgagctctcctgcttccacgatttcttccgcctcggcaatcgtgatcttgcctgccatggcggcaatgggattgaaatttctcgccgttttcctaaaaaccaaattgcccatggtgtccgctttccacgctttgacgatcgccacatcgccggtaatgcctcgctccagcacataagtccggccgccgaatgttttatgttcttttccctcggctatggaggtgccgacgcctgtcgccgtataaaatcccggtatgcctgcaccgcctgcacgaattctctcagcgagcgttccttggggaacaagctcgacctcaagctctccgcttaaaaactgccgctcaaaaattttattttcaccgacataggaagcgatcattttcttgatttgcttgttagccagaagcaaaccaagcccccagtcatcgactccgcagttattgctgacaacggttaaatcctttactccctgatctcttatagacaaaataagctgttcagggatgccgcacagcccaaatcctcccgcgatcagcgtatccccatcatgaatcagtttcgcagcttccttgcttgatgacagcacttttcccatattgatgcccctttcgttttcttctacactagaccagtcaggctgtaaatcgcgatcacagcaaatacggcagccgttttaatgagcgtgatcgcaaaaatatcgcgataggattgccggtgtgtcaaacccgtcacggccagaagcgtgataacagcgccattatgcggcagtgtgtccatcccgcctgatgccattgaaatgacccgatgcatcacctctggcggaatattgtaagcctgaatcgcctgtaagtattgttctgacatcgcgcttaacgcaatgcccattcctcctgaagccgagccggttattcccgccagcgcagttgtcgtaacggcgccatttacaagaggatcggtaaaagtatgtgaaattccgctgctcagcttatgaaaccccggcagcgcggcgataatgccgccgaacccgtactcggcacccgtattcatagatgccagcaaggcgccgccgatcccttcattcagcccttccttcatttgggcaaacacacttctccaatcaaataaaatcgttgtgatgatgccaatcactaaagcaatctccaccgaccaaatagcagctgctgaagaaatatcaagcctgccgaactcctttaatcctatggaagaaaaatcaaatccattcggataccactttggcaggtaaatggtaaaatatttattcactgcaccgacgagaataagcgggacaaaggcaagcgcgtgccgaatcgggcttttgtccggttcagccgcggactcaatcgattcaggagcaggagcattctgcgaatcaaaaccgccatagccttcgccagatgcctgcgcttttttccgccttgattccaaatagagcatcccagctgccagcacaatcactgcgcccatcaagcccagccaaggggcggcataaatgtctgttttgaaaaacgacgtcggaatgacattttggatttgcggcgttcccggaagtgcgtccatcgtaaacgtaaaagcccctaaagcaatcgttcccgggatgaggcgttttggtatgtttgcttcttggaacatgtttttcgcaaaaggatatacggcaaatacgacaacaaacaggctgacaccgctgtacgtcaagacagcacccatcagcacaatggcaagtatcgctctttttgccccgacaagccggacaattgttttcgcgattgatgccgcaagcccggccatttcaacgacctttccaaaaatggcaccgagcaaaaacactgggaaatacagcttaataaaacccgccatcttctccataaaaattgatgaaaaaaaaggaagcacatggcttggatctgtcagcagcaccgcgaataacgcgcaaatcggcgcaaacaatatgacagaaaatccccgatacgccgtaaacatcagcaaacctaacgccaatagaatgatgatcagttccacacacacatcccccgtttccacgaactagaaagcgtttacataaacctgtccgcatcggctgtttccgtcccctttccatatgtacgagaagcgtgggccaactattccgattaaaaaaggaaagctccttttttcggagctttcctctgccattcatttcattcctattaggatatcaacatcaaccgtaatatcggctgatttcatctctttcaggaggctgactcgatctttcggcgccgaccaggcaagcggcgtcatcttgagaagccagtggatcgcctgctggtcaagcgttttaacatagcgcagcctgacaggacggctgtgtgctgcatttgctgcaaaacgctcaacagctgccgcattggaatacgtgcgtcttggtgaatcagcatataaaaattgtcttaattctattaaataatcgcttcgcggcactacttttacgagcatgccatcattcttcagcagtctatgaaactctgcataattggacggcgaaaaaatagacagcacaacatcaaattggcgatcatgaaaaggagcacgcgccacatcggcaaccgcccacatctgatctttgaatgccttagaagcttttaagatcccatccttcgaaagatctatgccggttcctatcgctgctttccctgcataatcaaacccgcaaagcgcattcaaatgagaaccctccccgcaaccgctgtccaggatggtgaatgcctcatgaccagatgtgggatgactgatgagttctgcaatcacatcatggagcgggtcaaaaaaaccacattctccaatcagcctgctcctcgcttcaaaaagctcggcaccgtaactggttttgaccggcttcgtcagaaagttcacgtagccgtgccgagatagatcaaatgtatgtcctcgttctgtacaaatcaagcttttccctgatgccgcatccatagaagaatcgcagagcgggcatcgaaacatgctgaaatcaactgttcgcttcatgataaaaaacaccccattcattcatttttagataaatgaaaaaggcatagacaaataaacctaggcctatctcaaaaattggccaggtctggcagtttgtctacacctgtcattatctataacgaatgaattggataatcatgaaaaaaactccctttctgctgtatgggtttccccgtttccatcatacaacaaatatccaggagctggaaccttatagtgaagaaaaatcagtactgacatgctggtatcccgccaacatcatatcagcatagcaatccagcatgtttttcctttattttctcattttagaatataaattttattattgtgaaaatagttaaaaaggttgattttcaaaaagtgaaaggataaaatactgctatcatcttagaaaaagacattcttgtatatgatcagtaatatggtctgattgtttctacctagtaaccgtaaaaaactagactacaagaaagtttgaataaatttgaacgagttgaaaaggacaagttcttttctgtttgctcttatttttcacactttctgcacttccagaatttgtgaaggataagagctttttttgtttccataataaccctcataggagttgctatcatgtactttttactaaaccttgtcggtctcattgtgattatggcagttgtattcctatgttctccgcagaaaaagaaaatcaagtggcgcccgatcattacgttaattgttctggaattgctgattacttggtttatgctgggaacaaaagtcggaagctgggccatcggtaaaatcggtgatttcttcacttggctgattgcttgcgccagtgacggtatcgcgtttgcctttccgtcagtgatggcgaatgaaacagtagactttttctttagtgcgcttcttccaattatctttatcgtcacattctttgatattttaacgtatttcggcattttgccttggctgattgataaaatcggatgggtgatttcaaaggcttcccgcttgccgaaattagaaagctttttctctattcaaatgatgtttcttggaaataccgaagcacttgcggttatccgccagcagctaacggttttaagcaacaaccgcctgctcacattcggcttaatgagcatgagcagcatcagcggctccattatcggatcttatctttcaatggtgcctgcgacatacgtgtttacagccattcctttgaactgcttaaacgcgctgattatcgcaaacctgctgaatcctgttcacgtgccggaggatgaagatatcatctatacaccgcctaaagaagagaagaaagactttttctctacgatttctaacagtatgcttgtcggcatgaacatggttatcgttattttggcaatggtgatcggatatgtcgcattaacgtcagcagttaatggcattcttggcgttttcgtacacggcctgaccatccagacgatttttgcttatctgttcagtccgttcgcattcctgcttggactgccagtgcacgatgcgatgtatgttgctcagctgatgggcatgaaattagcaacaaacgagtttgttgcgatgcttgacttgaaaaacaatctcaaatcccttccgcctcacaccgttgcggtggcgacgacattcctgacgtcctttgcaaacttcagtactgtcggcatgatttacggcacgtacaattcgatccttgacggagaaaaatcaacggtcatcgggagaaacgtgtggaagctgctcgtcagcggaattgcggtatctttattaagtgctgcgattgtcggcctgtttgtgtggtagaaacattgagccatatcccttttcggatatggctcttttcattattgataaatagaggctggcacctgcacatcccggattcccgctgcataaggccccaagtcatactggccgaagacgatggcgatcccgtttgccgtaaagtaaaacattgtgtctttgtttagggttatatcctctttctttacatcagggaaaaacagctcatcgtgttttttgatatagctatataggtaatctctcgttttgctgacttttgttttggtgttcagaatctgatccagcgtcacccgcttttgtgctttcaagtcatagttgaaggactggacagacgttaaaccgtgggcgccccctgaatagatataattgagtgtttgaatgctgagcttgcctgccgcattgtatttgacgctgaaggatgtttgatattccgttttaaagccctgctgttcgcctgcttttttgtttttcaggtattcctgatacgattgttcaatgaaggctttcagctcttgattgattttcttttcaaacgcggcattcccgatgtgatgcacttgtggatacgttaactccttgatctttttgtacgtatgggtgctgacagtcggtgttttcgcttgaactgcttttaaagatggggccgcatatgcaaatacggaaaaaagcaaaactgcaatccccgcggctttcatcattttattccatttcatacaatctcctcctttgatgtcgttgtttatcattcccttatttaagcaatacacacttttatagactgattaaatcgaaagaagtttctaggtctaacagcatgatttttccaataaaaaaagagacacaggatgtctctttttttactgtttgcgcccagaaatcgcttcatgaacggcctgtgccaaatctgtatttccgaacatctctaataccgcaatgacagtctggtccggaatgtgctctgcttcgtgttttggcacgaccagatcgtccatggtttttttcaagctttcattcagcttttgctgcggatacgctttggcgtacagctccatcggatcaagatcatggttcacgcaccactgggcaaacaccaaaatcatcatattttcatcgcgttcgtaagcttcagcgagctgtttttcgttcattggtcatgctccttatgaaaagtatcttccttaaagatacaggagccgatcaaattcgtctatcccaatggcgatgagcagcaaccgcatcgataaatgccttgctgaaagcggtgtagtcaggttcatctttagccgttacgatgcctggcccctctgttgtcccgacagaggattgaagaaggtcaattccttcatttgccgcaccgatcgccttgtagtgattgtaagcttctctgataaacgccatcgcttgtttgttgtcttttaactccagtcctcctgcggcatagacggcatcatacagaacagaatcaaccgtcaggaacgtgccgttggcctcaagctgctgtccgctgccgcttgtcatataccccagattttgactgatgatatccactgtgattccttcttgctttaaggcttccagcactgtttgcagctctttttcatgaaatccgtttccggcgagtacagcgacttttcttgttgacgcggttttcactgtacgggcttggcttaacgcaggcgaagtaagaatttctttagatgctttacgcttcgcgggcgccgccacgcctactcctttagcgatttcttctgctaaatctgcatcgacattgctgaagacatcaacgacctgccgctgtacgtctttgcttttgaccttcccgacctcgaagcagaaagcagaaatgatatgctttttctccacaggagacatgctgttccagaaaagcttcgcctgtgagtaataatcgttgaagctgtcgcttcgctggcggatttttttgccctcgactttttcctgatagtggacgtagccgccttcttcagctgtcgctggcgacggatcattgttttgcagagagtttttatgataagcgacaggtcccttattgatcgtcatccggtgatagccgtcgtattgattgttatggaatggacataccggccggttaatcggaagctcatggaagttcggaccgccaagacgaatcagctgtgtatccgtataagagaaaagccgtccctgcaatagcgggtcatttgtaaaatcgatgcccggcacgacatttcccgggtggaatgcgacttgttctgtttccgcaaacacattatcctggttgcggttcagcgtcattttcccaatgatcttcaccggcacaagctcttcaggccacagcttagtcggatcaagaatatcaaaatcaaacttgaattcatcttcctcatcaatcatctgcacgccgagctcgtattcaaccttgccgccgttttcaattgtttcccacaggtcacggcgatggaaatccggatctttcccggcaattttctgcgcttcatcccatacgagagaatgcacgccgagcaccggcttccagtgaaatttcacgaaacgtgcctttccttgttcattgacaaaacggaacgtgtgaacgccgaagccttccatcattctgtagctgcgcgggatgcctctgtctgacatcgtccacatcaccatgtgagccgactcagggttattggcgacaaaatcccaaaacgtatcgtgagcagtcgctgcctgaggcatttcattgtgaggttcaggcttaaacgcatgaaccaaatccggaaatttgattgcgtcttgaatgaaaaacaccggaatgttatttcccacaaggtcatagtttccttcttcagtataaaattttgtcgcaaagcctctggcatcccgcaccgtgtctgcggagcctttagaacccgcaaccgtagagaaacggacaaataccggtgtcttcaccgaagggtcctgaagaaatttggcccgtgtatattctgtcattggttcgtaaacctgaaaaaagccatgcacgccatacccgcgtgcatgcacaacgcgctccggaatcctctcatggtcaaagtgcgtcattttctcccgaaagtgaaaatcctccatcagcgtcgggccgcgaaccccggcttttaacgaatgctcatcctctgatactcgcaagccttgatttgtcgtcattttcttcccgctgttatcggtcctgtactgctcaagctgctcgtcctttgagtgttcatttacacgtttgttttggtcatcactcatgtctgctccccctttttaaaacgaaacattctacagcacatttacccgtggcgttcttcatataaactgctaatccgctcattaggatttttggtctacatataaatatgcggtcatacacatttgaaataagccttcttcacagaaagaaaggatggaagcgcttaccaaaaaagctgttgaataggggaggtcatatcatgcttgccatactcggttttgtgatgatgattgtctttatgtaccttattatgtctaaccggctttccgctcttattgctttgattgtcgttcctattgtgtttgccctgatcagcggatttggcaaagatctcggcgagatgatgattcagggcgttacagacctcgcccctaccggtatcatgctgttattcgccatcctgtatttcggcattatgattgactcaggcctgtttgatcctctcattgccaaaatcttatcgtttgtcaaaggagatccgttaaaaatcgccgtaggcacagcggttctgaccatgaccatttcgctggacggagatgggacaacgacctatatgattaccattgcagcgatgctgcctctctacaaacggctcggcatgaaccgtttggtgttagcgggaatagcgatgcttggttcgggggttatgaatattatcccgtggggcgggccgactgcgagggttttggcttccttaaaattggacacgtcagaggtctttacaccgctgattcccgctatgatcgccggcattctctgggtgatcgccgttgcttatatcctcggaaagaaagagcggaagcggctcggcgtcatttcgattgatcacgcaccgtcttccgatccggaggccgcaccgctcaagcgtcccgctcttcaatggtttaacctgctgctgactgtcgctctgatggccgcactgatcaccagcctgctgccgctccctgttctttttatgactgcgttcgccgtcgccttgatggtcaactatccaaatgtcaaagagcagcagaaacgaatctcggcgcatgcgggtaatgcgttaaacgttgtctcaatggtgtttgctgcgggcatattcacaggcattctctccggcacaaaaatggtcgatgccatggcgcattctctcgtttcactcatccctgatgccatgggcccgcacctgccgttgatcactgcgatcgtcagcatgccattcacctttttcatgtcgaatgacgccttttacttcggtgtccttcccatcatcgccgaagccgcttccgcttacggaatagacgccgctgaaatcggaagggcctccttgctggggcagcctgtgcatctgctcagcccgcttgtgccttccacctatctattggttggaatggcaggcgtcagctttggcgaccatcaaaaattcactattaaatgggccgtgggaacaacgattgtgatgacgattgccgcacttttgattgggattatttctttctaaatgtatgagcttgatcgtagcattgagtacagaggggagaagatcaaataggatattatgagtgaatagaagattcatgccaacaacttctcattacaatcataagagcctgctatattgcagcaggctctttcacatttggcattatttttttgtatagcgcacccagtcataatgagcgtatagcggatttacaccattgtaggagccaagccattcatcgacacccgtgccattccacaagttcatcatgatctttccaggtgttgtcggaatttggtttgttgcagtatgttttaattgcccgtcgacataccatttaatagagtttggctgccaatcgaatgcatacgtatgataggcattggctgcatcaaacccgagatcaacaatcttctcatggtttcctgcaccatttgtataatagttaaattgaaccttcgttgtgtcttttcctaaaaattcgatatcaatctcatcccaaggagttccatctgttggacctgtgtaagtgaagaacgatgaaacgatccctgtgtttttagctggtttcattctgacttcataaagtccatagccatatgtttgaacagaacggttttccccgcagtcaaacttgttataagatgggcttgttagcgctaaacgcatttcacccaatgacgtcactgatacgttattagcccgccacgtgcagttgaacatatttccattcgaataaccatctgctttttgccaaaaaccggagttatagccgttaaaagggtcaaaaaacgatccacctgtttgagctgaggcagtagaagtgactgcaaacaaactcataaacaatccagtgacaagaagcagcaacactcgtttcagataaggcatattggcattcccctttcattgaaagcgttttctatgttgatcttacatgattcttttaaaagggaacatcggtcaaaataatgataataccgaatcttacttacttgaatcctgtaactatcttcatcttccccctgaaaaaaataaaaacctaaattaccatcagcacagacagagatgatccgcactcattgtaatttaggttttgcctgctttatcagtaacaatcctgccattttcatatgtgaatgtaagaaaaaacgaacacacgaaaataaaaatgtcagcgctctcattatgcttgtttaactaccctttctatgtgaatggttaaatacagcagctcgtcacttgtgagcttgtgctcatactcccgctcaatgtaggtttggattttcttcgtgcattcatacgcgcgatgatacttttctttcactgtatccagcaaaaaatcgtcctggctttccatgtgagtgccgttaaaaagacgctgcgcgaaaaattttaagtgggtgacgaaccgataatagtgaagcgattcttcgttgaattcaatcttaaaatggtattttacaatactcaaaatctcttgcatgacttttgtaatgttgataatattgggcatctcttcattcagctcggcatttacaatatgcagagcaataaagcccgcttcatcctctggcagagacacaccagtcttgttttttaccataaccaacgcttctttgccgatcgcaaattcgtctttgtacagccgttttgtttcccacagcaaggcgtttttgatatcaagccctttctggttgcgctggatggcaaagttaatatggtcggtcagcgacacatagatgctgtcgttgagctttttgccgagctgtaattttgcgtagctgataatctcttcggatacttccatacactcgatcggtatatcatacaaaagggttttgaacttttctgatacatccttgttatcgagcgtgaacactttctcaatgcgggcttcatcgacatcatcgccggactttttctgaaacgcgagccccctgcccatgacgaccaattctttcccctgttcattgaccacactgatcacattattgttgatcaccttcgcaattttcatgacatgtccctccattcaactaagaacagactatatcttgattgtacattctttttgtactaggtcaatatcatcagggaaagacggaagctggtcagtacaattcactccgtacctgctgcccgggctgtttttgaagcagcgcctccagatggcgttcaaatgatgccttgtcagctttctgctttttgacaatgctgttcatgattttgacgctttcggcgctgtattgtgtatattgttttttcagctgatccagctgctgtcttgtcttcttcgcgtttttcggtgtgacttggccgatgagtttgatcatattgtctgcggtctcaaaaaaagcggctctattttctgtcagctgctgaatttcgatccggctcatgtcttgattacgcgttttttgaagcaaggcgaccgcctcgctgttttgttttttgagcgatttgttctcaagcttaatcgattcgagattctccttcgcaatgtctgcttcttcttcagtcatgctgattcgcacgaagtattctggattgccgattccataatcaaatgcttcgctcacttgtatcatggaactgaacacaatggccagctgcctgtcgcttgcgagggcttggaaatcctgctttttcttactgctcatcggtttgactgcggtttgttttactgtcttttgatcacagtctgcgaacatctgagcctcaccttcactttcgcatgcgctcatcacaagaactgtgaccagcaggcttatacacaagcctattcgcctcatgctctgtctcctctctgctgaatcccttctggaaaataccataaaatatagttaaatggtaccagattcacctaaccccagcaataaatcaaaagtatgatttgaagcgcaaaagcataaatattttgtaaaaattgacgtgcattccattcttttcaggcccatttttcgtacaatagaagtatcgttaccggagagggggctctgatgatgaaacgttttacgaaacaagaaaacagctgggtattatatgactgggcaaattctgcttactcaattgtcgtgaccaccgcggtatttccgttattttataaatcagcagctgcggaaagcggtgtcagcgccgctcaatcgactgcctatctgggctataccattgcgatttcaacgtttattcttgcgatgctcggccctattttaggcacaatcgccgactatgaagggtgcaagaaaaagttcttcggtttctttgtgtcagtcggtgtcgccagcaccgcgatgctcgcctttatccctagtgaacattggctgctattgttgctgttttatacgatatcggctatcggtttttccggcgccaatgtgttttatgatgcctttctcgttgacgtcacgcctgagaagcggatgaatctcgtctcagcacggggttttggcttaggatacattggaagcacgattccatttatcatcagtattgctgtcatcctgctcgcacaagcagagacgattccagtgtctgtatcggccgcaagccagctgtccttcttcataacggctgcctggtgggggctgttcaccatcccaatgattaaacatgtccatcaacgctattacatcaaaaaagaacctcatattgtcatcaacagctttaagcggctcggccaaacgatgaaacggatcaggcaataccgggcacttttcctcttcttgctcgcttatttcttttatatcgacggagtcggcacgattattacgatgtcgacatcctatggatcagatttagggatcggctcctcaagccttctgatcatcctatttgtcacccaggtagtcgccgcgccgttttcgattgtatacggaaaactggcagaacgcttcacggggaagaccatgctgtacgtcgggatcgtcatttatatgatcgtctgcgtgtatgcctattttatggagacaacgcttgatttctggatactggctatgcttgtcgccacctcgcaaggcggtattcaagccctaagccgttcctatttcgccaagcttgtgccaaagcgccacgccaatgaattcttcggtttttacaacatttttggaaaattcgcctcaattatggggccgctgctcattgccgtgaccgcccagctgaccgggaaatcctcaactgcggtgttcagtctgatcattttgtttgtaattggtattgtgattctggcctttgttccggaggagaccagcgccgatgtcagccagcagcaaaatgacctgcccctttaactgggagcaggtcattcatcatttattcgctttattcaccttcagctttttccctttgacggttgtgttcttcatcactttgagaatatgagggcctttaccatttaagatctcaacgtatgaggcgttatccatgatcgtgatgatgccgatgtcgtcagctgacacaccgtcaattttggcaatcgttcctacaaaatcaacggctctgattttctttttctttccgccgttaaaatacagcttcataatgtctttattcagctcttcgcttttgtcctttttgctttccggacggtcattcagtttagctagaaattctggtttcttccttgccacttcctcttgagaaggtgcttctattttttggatttcaaatccgatatattcttcaatgtcggctaaaaaccgtttttcgaaggccgtgacaaacgaaatggcctttcctttgttccctgcgcgtcccgttcggcccgtgcggtggacatagctttccttttcaaccggcagatcatagttgataacaagggagatattttcaatatcaatcccgcgcgcggcgacatccgtcgccactaagtaacggtactcgccacgtttaaattcattcatgacgtcgaatcggtcttcctgaatcattccgccgtgaattttatcgcatggatatcctaagtcatccaattcatcggtcagctgattgacgtgctccttcgttcggcagaaaatgatgcagctgtcgggattctccgtcatcagcacatctttcagcaatgaaaatttatgctcttctcttacttgaatcaccgcatgttcaatatttcttgtggtaagcccggccgctttgatttcgatatgctcggggttttgcatatattgacggctcagcttctcgatatcctgcggaagcgtcgccgaaaacagcatcgtcgtacgctcagtcggcagatgcttgataatcgcctccacctgctcaatgaagcccatattcagcatctcatccgcttcatcaatgaccaaataagagagacgatccaacggcagcgtgcctttttcgatatgatccagaacacgtcccggcgtgccgacaacaatgtggcttttttgcttaagctcagctttttgtttatcaaaggaggattttccaaatacggctgtcgctttgatccgtttaaatcgtccgatgttcgtgatatcttcctttacttgcaccgcaagctcacgggttggagttaaaataagcgcctgcggcttgttttcatcccaatccgccagctcacagagaggaattccgaacgaagccgttttcccgcttcccgtctgtgatttgacgacaagatcctttcgttcaagggcagcggggatcacgctctgctgcaccttggtcggttctgtatatcccagtccttccaatgctcgtaaaatgtcatgactgatttgatagtttttaaaatgactcatgtataaactcctgtctcttgcagatgttctcattatactctaattgacgaaggcatatgtgttttgtcgaaaagtgatgtattaaaagccatcgattccctggcgttttagctcctgaacagccaatcgcgccagtgcgtcggcccccgcgcgattcggatgcagcgtatctccatccatataaagcccgagtgttctttccggaccgatcgatgtaaagtatgccgagctgaggacatttaagtcaatgaggtgtgttttttcctcttcggccaaagctaaaatagaggccctgtaccatctgtttacagacgaatggatgccttcagaagtaaaatcggtcgcccggccctgaggcgttgataggatgacgtccgctcctttcgcttttacctgacgaatcatatcacgcatcatctctttaaactccgcttcagattcattatgcttcggatttgtgtcattaatgccaagctgcaatataaaataatctcccggtttaatatacttcaggatcgcctcaagctgtccatcatttctgaaccctctcgcgatctgcccgccggacgccatgtttctcacttgaaaggtgtgtttatcgatatagtgaggcagcatctgcccccagcccgcctgcttgctgctgttgagcggataataattgcacaccgtcgagtcgccgccgacataaatggttcggttcgtcaccggctgatcagacaatttctttattttcaaggcgctaagcgtaaaagcggtgccagctttcccctctgtcaccagcagattcagctgcccgtcggtgacaggaatttggaacgtatcctccgcgccatcccctgtcatattaataacctgaaacacgccctccgccgccacactggcccttgccgtattgccaagcgtcaccttcacctcataaaggccgttcgggagatccacattaaacgtgttattgcttttcgtcccatacgctaaaaactgaaccgcatcactcttcacaccagtcccggatgccgacacatccttcatattctccggtgtttgaaaaccgtagccctttgaccgatcataccgatcagacgccctgacaccaatataatcaggctccaccgaaccgcttccaaagtcaaactgatacaccttcggctccactgccttcacactctcaatcccgtcaaaacccaacatcaacatcatcacaaaaaccgttgccatccattttttcatcaagactccccctctatgaaaacgcatacattaatgcatactcggtgattgtttctttatgatggctgaagggagaaaaaaatggcgttgaggaataaaaatgaggggagagtctcaagaaggggaaaatcagtgtgacttcttgtcacacttgatcacatcccaacctccgcaatagaagcttatttgatcttcttcgtcatacacataataacggagtctttcccattgatcgtcagtcggttcaatctccaactcaaccgcatcaatggattcaaggtcatccagccttgatgcactaatgtcttcaaaccgcaaatgaatgtcacaggtttgagcagatagttttaattcaaacacaggaatatgaatataacgatcatcttctttcatatagaaagaaaactcgttgaatgtaaatggacctgtatccgcatcagaaagatgttttttcactttttcgtattgtgtgatattcaaatggattcctcctatttttagttaccgctaaccatatagatgtcaacagcatcatattcaaaccacatgatcccttcgcctgagtccgttagacaatggagcttcccttctgaaaaatagcttttatccggttgaggatcagtgatcagaaaaacatcatcattgatggaagctagcagaaagagaaaatctgcaatatcccggtctgcttcctgtaatatggattggaaatggaattcccttttggccagcttcgtcaccttgtaagcatgaccttcaaaatactcggacaggtcttctataaatgaaccagtcgttattacctgtatcatgattcgaccgtaggcaagccctgcccaaaaacgataaaacgactctgcatcttcaagttcgcatgacataacggtttggtcaggcttaagctcgatcatgtccaaattgccaatactgcttatagaggttatttccataaaatcttccccttatcagttgatagcgcaacgcaaatctcttgtctgacttgttcatacaagagaatgtgatgatacagatccttatcgtttttgatcgtatccggaagtatgtcaggatacagctcaaaaaagcttttctccaacgaacgccgctgatgcccggacatccttttattcgccagcacataatccaaactcccatcaactagcataaaaaactcatagatttccgcttcaaagccgtacaattcatcaggatacggcttttcttcaagcacttgctgtctttttttcagcttttgaagcacgttgatcctctccctccgcaacaaactcatttatcttgaaacaggataggcggatcattatctatcgcctccaacagctcttcaccaaacacagtgattgtcaatttccacgggtctcccaaaagtccccaagagaagtcctgatgaaaaaagaaataatagtctccatttggaaatacgggaacaggccattcgccaaattcatcctgaggcattgtctgatgagggctaaagatatatccgtcatgctgccaatctaatgcgtacatcacatcgctctttccagtacatgattgaaacgcttttaaaatcgaagcctctaaatcactcagccttctgaccatatcatcattactggctttatcgctcatcccgcttgagatatcaaacacttgatatggatcaggcgggatgatgtgatgacatctgcttccgggtttccattttatgatcttgttcacttctgaccagatgcggtcttgttttgtctgacttaaggcgtgccaattcatcataatctcatccctacaccttattggatatcctgcttataaacaccagaagaggccactgcgtaaacagcgttactcgacagtttcagctgttgaacatctaggctgcaccattcgaatcacaacacttcacttcttgcatcggcagactcacatcggcagaaatcaaataaagagacggctctagctcttcactgtaacaattgaacgtcccaaccaaaaaaccttcttcggatatcgcgagctgatcaaatgcttctgagtccggctctttatccgacagaatccatacccgtctcacgaccgtgtcgtcttagtttttaaatttgcagagtatatataatcattactatcgctttttaataccaactaagttttcaatatattatatgctctattgttttatattttttttaagccaatcatagtcattaagagttgatatttcatcaaaatagtacattcacttttccttttactaattgagaaagctttttttcgcaccaagaatttgaaataactgtattattgatttaacatgttagcgtcattggaataggattacaatatttttctggaatgtttatgttattttaagaatcaaaaaaaggccgcataggcctttttacatttttttattgcatttgttcaatatccgtaccctcagctgtcacattcgccttcccctgcctcctgacaagcgtcaaggccatacccgcaaagatcagcatgatgccaagcgtttgatagaggtcagggcggaagcctgtgaagacggtatctagcacgatcgcgacagcggggtcaagaaatacaatgattgaaataaatttcgttgataaaaatcgcaagctgtcaaaaaacagcaaatatacaatacctgtatggatgatgccggtagataccaccataatccagtttccctgagataggtccgcaaaagcgtcaaagtgaataaacggaatcaggatgataacccctaaacctgtctgcaagaaggtggtcgtgtaaggactgagattgtgaatgccttttcccaataaagtggtgaacgcataaaacagtgcggcgagaactgcccatatgatccctgatcccatcagctgtgtcaatgatgtgctgccgttaatcccggaaatcagcgcagtcccaagaaaacagatgataatggagctgacagagatcacatttaatttctctctgtagaagaagctccccagaagaagaacaagcaccggcgctagatgataaacagagatggcaattgtaacggacgtttcttcaaaagacttaaataagaacacccagttgaatacaagaaagaaaccgcacgccaatgtttgcagcacgtctctcttgctccatttttcagttttatactggccggacgccagccagcaaaggcctaaaaacagcgtcgcgcaaaggcagcggacaaagaccaattcaaatgacggcagattggtatgctctgagaaaaagccgatggagccgaaaatcaccatagagatgaccattttgattacggctgttgatttttgttttgacgatatggatagatcctgttgcatcaaacgtattctacctccagtactgcatagcataagctgttttttatgaattcagaaatctacacatagaattcctcttttttacatgtagatattataacacttctattctaaataaaaaaaagcgcccttgggcgctttttttacaaatctatcgaacaatcaaaaccgggcatgttgataattgagacactttatggctgacgcttccaagcatcatttctttcaggccgctgatcccccggctgccaactacaatcaggctgacgcctttctcttttgcgtgatttagtatctcatacgccggctcgccattcgcgtaaatggtttcagcttgaacgcctttttcggctgctttttcttttgcattctcaaggattttcaggccctcttttttaacctcgttcctgatttcatcaataaagtgttcaggcacatagacaattcccgtcagagaagaagtcgtgacgacggcttctctccccacatgaagaatgcttagttccgcttgctgctcttttgccaaatgcactgcggcatcaagcgcttttgcactcatgtctgatccgtcaatcgctactaacattttgttaaacatgctcttcccgcctttcggactgtgggtggttcatctttctcttttattgtccgcctgcattttgttattgtcaattgaagcgcatgagttttcaaaaatttgtcagatactctctccgtttgtggcgatgacctgctgataccagttgaagctttttttcttgatgcggttaaatgttccatttccttcattgtccctgtccacataaatgaaaccgtagcgttttttcatttccgcagtagatgcgctgacaaggtcaattggcccccatgatgtgtatccgattaattcaacgccgtccgcaatggcttcgcgcgcttcaattaaatgatcacgcagatagttgattctgtaatcgtcctgaatcgtgccgtcctcttcaaccttgtctacagcgccaaggccgttttcaacaatgaacagcggcttctgataacggtcgtataaggtgttgagcgtgatgcgcaagcctttcggatcaatttgccagccccattctgatgatttgaggtaagggtttttgactccgcccagcaggttgccccctgattttgcaagctcttccggatctgtgctcgccgccatcgacatgtagtagctgaatccaatataatccaccgtatgttctttcaagagctcttcatcgccttcagccatttcaatttcaatattgttttctgccagatagcgtttcatatatcccgggtatgcgcctcttgcctgaacatctgagaagaaaagtgttttgcgctcattctccattgccgcgaagacatcctccggcttagaagtcatcggataggttgtcgttgccgctatcatacagccgattttcgaatcaggaatgatgtcgtgacccgctttgacagcaagagcactggccacaaattggtggtgtgccgcctggtacatcgcgtttaatttgttttctccttcttcaaagacaagaccgcctccggtaaacggcgcatggagcaccacgttaatttcattaaacgtcatccaatacttcactttgtgttgatagcgtttgaaaaccgttttggcatagcgttcataaaactctatgactttacgattcttccagccgccataatttttcactaaaccgagcggcatttcataatgagagatggttacgacaggctcaatatgatgctttaacagctcatcaaacagatcatcataaaatctgagaccgtcttcattgggctcctcttcatcgccattcggaaaaattctcgtccacgcaatcgatgtgcggaacgccttaaatcccatttctgcaaataaggcgatatcctctttataacgatgataaaagtcaatcccgttgtgatacagattcaaggaagtcattgattcatcaaatggagacatgatcccgttcggcgatacgtcagctgtcgaaagccccttaccaccctcgttataagcaccctccacttggtttgcagcaactgcgccgccccataaaaatccttctggaaatcgttttgcgtttgaactcatattgatcaccccattagttttttcaagataaagcaagcagcgcttcttttgtctgtactttaccgatctctttcaccggcgaaaatgaatattggtctgtgttggtcacgatcaccggggtaatgacgtcatatcccgcggctttgatttgctccagatcaaaggacacgagcggatctcccggtgcgaccttgtcgccttctttgacgtgagccgtgaaccattgcccctccagcttcactgtgtccaatccaatgtgtatgagtatttcagctccctgatcactcgtaatgccaattgcgtgttttgttttaaaaatggtggtaacgcttccacgaacaggcgacacaacttctccttcttcaggctcaatggcaaatccttttcccatgaccccggcagaaaacactccgtctttgacttcacttaatgctttcacttctcccttaatcgggctgtgaatgatctctctgctgccttcatgcagtgccggctgctggctgccgtcagaaggcacatcctcgaatccaagcaaatacgcagctgctgttcccgccgcaaacgcaatcacaaggccgatcatcgcgtaaataaacgttgggccgataaagacagggatgctcggcagacctgcattccccccgacgatataggaagcaacacccgtcatgccgtaaaacgcgccaccggctgcaccgccaatcaaagcggccgcaaacggctttttcaatcgcatattcacgccgtacatcgcaggttctgtaatccccatcagcgccgtgatgcttgtggtaagcgcgagtgatttaaattttttgtttctggagcgaaggaagacggcaaatgatgctcccgcctgccccatattcgccaaaaacatagccggcagtaaataatcgtggccgttttgagcgatgttgttgatcatgatcggcacaaaggcatagtgcatgcccgtcataatgattaaagagaatgtacccgccagcaaaatcattgccacaagccctgcatgatcaaacaaataattgaccccagaagacaagtattctcctaaaatagcgccaagcggaccgactgtaatcaatgtcagcggcacgacaatcaatagcgtgaatgtcggaaccacaatcaatttgagagatgcgtgtgtgaaacggtcaatccatttttctacgtacgaagcaatccaaatcgccagcaaaatcgggatgaccgttgacgaataagtggcagcggttacaggaagcccgataaaggaaatcggtttccccgcaccgagcagggctgtcaaatccggatgcaggatcgccgccgcaatggctgccgctacgtacggattgcttccgaattttctcgccgcactcatcgctagcaggagcggcaggaagtagaacgcaccgtcaccgacagccgtcaaaatgacatgaacctggctcttctccgccatccagccaaacgtaactgccagcgcaacaagccctttgatcatccccgctcccgcaatcgcaggcagaatcggggtaaacacaccagaaatcacatcaaagaccgcactcagcacattctttttctgagaggatgaaccagcgctcttttcatcactgagattgctctgccgcacaatcgcctgatacaccttcggcacatcgtttccgataatgatttgaaactgctcgccgctgatattggtgcccatcactccaggcagctgctccagctgactgcgatccgccttagcgttgtcatgaagattaaaacgcagcctcgtcatgcagtgaatcacgcgctgaacgttgtcttcaccgcctacgagttgtaatatgtccttcgataatttatcataatccatgtgtatacctcctttttatggggggactgctgggagaaaggtggccgcctttcttccagctttttttgtatcaaatgctgcatcacctcctaaaagagaataaaaaaaacctaaatgacacagattgcgagagtctcctcctgcacctgcaccatttaggttttgcctgctttcgcagtaacaatcctgacgggtcgttttatttgtttgtaggatatactttagcactagattcgcgggatgtcaacgctttcatttttagtgttgactatcgtttctagaacaaaagtaatcataaagatttgaacttagtattaacttcaataaaaaaatattgtaattaaaaaccttgaaaggcattttttccaatcaaggttatgaatcgttaccgtttaaatttttttaaagacttctttatctgtactattacattctttagccaatctattggttctaaattaaacgcaagaagatacacgccatctgcgaaagattgaatgtaatcgtttttctcattttctgaatgctcactttcaataaaatccgttaaaaagacaatagcatcctccaaatattctttactttcctctgttaataactcttgtatagcgtcatcaggagtttcaatatcttgatggaaagccagccaaaaattgaaaaacagggtccttctgtttattgatcaataacatgtcatcttgctacttaagggagaggtaacgggataatgttaaaatcattcatcatctaataaatcaagataatactgatcattctcttctatttttcttaagaactcggtaagagaagttgcaatttgaatatcataatagtaaatcggatttttattattattatttaattcaattgacattaatgccgattcactaccttcaaaaaatattaatttatcattctcaaactcatcatatatttctatgtcaggataaaattcaaagtcatttatcctcaatcgaaagtcccttacagaatatggatccaaaatgcgattagtattaaactctgatcctttaataaacccatagccaacttctaaataaaaattcactaattcactaggtaattttaagtttaaatttttttcaacctcttcaatctcactttgattcactggataaaaatcattttctttgtttgcttttataaaattataactcatttttttttgcctcctttaaataattcatttgctggtgagcctgtaccatgaatcccagcttgatgctcgttaggaaattttgctggatgcatattccaccattcatgttctccgccaaaagtattctcaattatatggtgagcatcatacttatcccctttttttctaataattttacctgttttttcagatacaacattttccttataaacaggccatttttgtccagtgttttcttcccattcttttataactttattttttactttatcaaatttagtcctgtgttttgcagtctctattggtgacatttttttatattctttatttcttaaggcttcctttaatttatctatttgatttttaggtaattctctacctgtgcgttgttctatatctctagcatacttttttattaaatcagaattaattttattagcagatccacttacatcattcgcaattttccctttatccttagcaacgtttttaacttccgaagccttcttagcctttttcccatcattaataagtttattaatatctattaacttttctaacttagctattttggcaaatggtactgagtttatggaggcaacaacacggtcttttcctgtgactttttcgcctgataccggatctctgcccgtggctgctttaaatagatcatacacgccggtaagttctacagctgtctctaaaattttcacatatccattctcatccactttaatgtccgaaagcgagacgacaggttcaagcttcatgtcattaccagatatgtatacattgtaaagtgtatcattataaacgacttgcttaacctctgcatttgagaaatcagtttttatatgttctctatgttcactcgtattatacactttaccattgataacgatgatatttttacttacctttttagaatgacccgttttgacaactgaatctactttagacttttcattctcggccagtttcttcagcatcatctccatcggtgaatcatccgactgcttcatttgcgggttaatcgcgccgaaggtttggttgatgttttcttcctcctgtgatttcaggatagagccgcttttgtagcctgtgatttcaattttcggaccggtatacatggtttcgagctggtctatatattttttcatcgtttgaaaatctgattttgcggtttctagtgcttgggtttgctggccgtcaaattgaaagagcttattcagggtgtccgaaatcagtcgctcagcctgttctgtttccatccgaaaaaaggaatcattgactgtcggcaggctgacgatgtgatcaatggctgatgtctggcgattcactgcgtctgtgagctgttctgtcacttctcgtgcatgcttgaccccgtgtcttgcatcgtgtgagagaaaagcctctgcaatcatgccatgggagtcagattctacagaggaaatcgcatgctgtgtttgtttcagcacttttttgtattcgtcgataaacatgccaaagaaaaggagaaaaggcttgtggcactcctcgtaaaaggtccggatggcatctccgccttttcctttcagcgcatccttcatgcctgccagatgctcaacgcttttttccagcttctccagctgttgcttttgcttgtccagtttctcaatcgtatgctgaatgccctcgtgaagagcgtggacatctaatgttttcaaacccttgtcctcccgcgctttatttcatggaagatgatatgttttcgtccgtttccttcatggcgtttaccgcgctttccgtttgtgcgatatgcttggccagaacagacgcatatgcttcagtgagctctttgatgtccttatttaattgctcgatggacttcacaacattcaaatggtttctgcctgagagatggccgggcaaggaggacttgagtttagctgaattcttgagctgagaaagcccttgcttcactgtgccatacaccattttaatttcctgtgccatttgtgctcacctcactttttatgtttttccttctctatttcatgctctatcctcgtaatttggcgtcttatggaatagacatcgccctctaatgagtggatttttccttctatgctttcgatgattccgctgacttgatcgcttttgatttgctgatatgctttgttcattccttcacgaatatcttcaaaccgctccgcatgtgttcctctccatgcatccggggtgagatgaggccggtgaatgagatgctgggcctcggagaattcgtgtttgatttgcctgatttcgtgcagcactcgttttaactgatggatctgttcctgcttttcatgtaagtcggcttttaccgaatgtaacaacatttcactatgcatgccgcaacacctcatgtttctatcaaactgtgtcaattctttacaatacagactattttcatattacatgatggatcatattggataaataggtaaaaaggtttgtcttgagagatgtttaactggttctaaaatgctaaaaatagatctcatcaccttatgagagggagaaaataatcataggagggactttttatttaagtctttaatctctctttcatttttattttttctcccacttaaccatttcttatagtcaataaagctcataaaaaaaacgccttcctacgaaggcgcttctccatcttatttagatccccaaacagcctcaccgctgccattcaacacactaaacgtcatcacgttcttctctctcaccgaatccaactggcgtaaaaatacgccattatacttcttgccagctaacataagttcagctgtattttttccggttttcttccatgttccggtcatttccccggaaatggtgtggtttttgttgagctggatgttgatggtttgtttgatgtcggctgagatgtcttttccgtgctggataattttgtatgttcctgtgatgtctttttgttttacttctttcaatgtttcgcccgcataacgatatggcgctgctaccggccagccgtctttgttcatgaacagttggtggactctgacttcgtgttcttcacccctgcccgggaagcgggtgtggaagattaaataggaacgcccggttttctggtcatagtatgcggagttgtggcctggtgagacgtacccggtgcctttttcattttctgtttcaaaagtgtagctgcccatgagtttgacgccgtatggttcgatggaacggtcgtcgaagaatgtgccttctttgccgcggacgtcgagcattggattgccttctgcatcatagtaagggccgtctggtttcttggagcgggccacacggatgttatagccgcctgttgcatcgagaccgccatatgataggtataagtagtagtattgggtgtctggattatagagaacatacgggccttcgattctgctgtggttgccgccgagcagttttttcccgtatccctgtccaggaagcgggaagcccgttttcggattcatttcaagtatgaaaatgccgcctgagtatgatccgtacaccatccacagcttgccgtctttatcaaagaaggtatgcgggtcgacgacattcggatgtttggttgcgtcatacggtgttccatcactgcttgtgccttccattcctgatttcaaaaagatgcctttgtttttgtatggcccttcgatgttgtcagcgacggcaacacccatggcggatcttggtgagtcgccgcggcaggcgttgtagtacatgtagtatttgccgtccgccagctgcgtgacgtcagccgcccaaagagtatcggattgcgcccattcgaaggtttcttttaattctttatagacattcgggataagtgggttgtcgttgcttacgctggtggtcagctgctgccattgcatgaggtcatttgtttttgctgaagcgagatgagatccaaaaacataaaaggtgccatttgtttcaatgatggaaggatcatgaacgctgacttctttaaatacgggtttttgtgcattggcggagtttggcagggtgaaggccatgataagagctgcaagaaaacatacacggaacaatcggttgaacatctaaacaattcgcctctcttttttattaaattttaaacgcttacatatctctatgaagataccccggcctattaaaacagccgaatgttttcatattcatccagataggtgatttctcacttcacttacatagtcagactgatgtctgtctgttttgcgcagaacttgttgcttgcatatcctctccttcatagttcaactcttttgctgtttctccttcttcaattacttctgtttctacatttgcgtacgtaatgaataccttgtccagccttgtgaagtcgtcgacttttctccggtaactacgcctcttttgggcactttaccctcattgtcagcaatatgacagcggccgcttccactcctgtctggccatcatgtgcaatgtgctgaaagaaaacccgtcccgcattctctgtcacactattacaataccaatctaacttgttaaagactgtaaaaaaccttttgacttctgctgctgaaccaattaatataatactcagttaatagttatcagaatttttaggaattgagtgattcatatgacactgcataaagagcgtcggatcggccggctgtctgttctcctgctgctgaatgaggcggaagaaagtacgcaggttgaggagctggagcgagacggatggaaggtctgtcttggcaaggtaggatcaatggacgcgcataaagtagtagccgcaattgaaaccgcttccaaaaagagtggtgtcattcaatctgagggttatcgggagtcacatgcgctttatcatgcgacgatggaggctttgcatggcgtgaccagaggtgaaatgctgctgggatcgctgcttcggacggtgggattgaggtttgccgttttgaggggaaatccttatgaaagtgaagcggaaggcgattggatcgctgtctcgctttacggaacaatcggggcgccgattaaaggtcttgagcatgaaacattcggcgttggaattaatcacatatgaaacagcccatagatcttagacgatagggggctatgcgtgaaaacagaagttcacagcatagctcctttttgtatgggcgctttaccaaagtaaagaaaaaggagttgggcttatggtgactttagacggttcttcattgacaacagccgacgtcgctcgtgtgctgtttgattttgaggaggcagcggcttctgaggaaagtatggagcgcgtgaaaaaaagcagagcagcagtggaacggattgtacgcgacgaaaagacaatctacggcatcaacaccggatttggcaaattcagcgatgtcctgattcagaaagaagactcggcggcgctgcagctgaatttaatcctttctcatgcctgcggagtcggcgacccttttcctgagtgtgtgtccagggcaatgctgcttttgcgcgccaatgcgctgttaaaaggcttttccggtgtccgcgctgagctgatcgaacagttgcttgcttttttaaataaacgcgtccatcctgtcatcccccagcagggatcacttggcgcaagcggagatctggcgccgctttcccacctggcgcttgcgctgatcggacaaggagaagtcttttttgagggggaaagaatgccggcaatgacaggcttgaaaaaagcaggtattcaaccggtaacgctgacatccaaggaagggcttgccttgattaacgggactcaggccatgactgcaatgggggtggtcgcctacattgaagctgagaaactagcctatcaaacagaacgcattgccagcttaacgattgaaggtttgcggggaattatcgatgcatttgacgaggatattcactcagcacgcggctatcaggagcagatcgatgtcgcagaacgaattcgcttttatctatctaacagcggcctgacaacctcccagggagaactgagggttcaggatgcctattcattgcgctgtattccgcaagtacacggtgcgacttggcagacactaggctatgtcaaagaaaaattagagattgaaatgaacgcagctacagacaatcccctcattttcaatgacggtgacaaagtgatttccggcggaaactttcacggacagccgatcgcctttgccatggattttctgaaaatcgcaatatcagagcttgcgaatatcgcagagcgccggatcgaacgacttgtgaatccgcagctgaatgacctgccgccgttcctgagccctcatcccggtctgcaatccggtgcaatgatcatgcagtatgccgcggcctcactcgtttctgaaaataaaacactggcccatccggcaagtgtggattccattccgtcatccgccaaccaagaggaccatgtcagcatgggaaccatcgccgctcggcatgcttatcaggtgatcgcaaatacaaggagagtcattgcgatcgaagccatttgcgcattgcaggctgttgaatacagaggcatagaacatgcagcgtcctatacgaaacagctttttcaggaaatgagaaaagtcgtgccgtccattcagcaggaccgtgttttttcctatgacattgaacgcttgactgactggctgaagaaagaatctttaatacctgatcatcagaataaagaactaagggggatgaacatatgactgatgtaaaaaaatcaatccgtgccaacagaggaacagagcttgaatgcttaggatgggagcaagaggcagtgcttcggatgcttcgaaacaaccttgatccggaagtcgccgagaagccggaggacctcatcgtatatggcgggattggcaaagccgcacgggattgggacgcttttcacgccattgagcattccttgaaaacattaaaaaatgatgaaacattgctcgtgcaatccgggaagcccgttggcatgttccgtacacacccgcaggccccgcgcgtgctcctagcaaattctgttcttgttccgaagtgggcagactgggagcatttccacgaacttgagaaaaaagggttaatgatgtacggacagatgacggctggcagctggatttacattggctcacaaggcatattgcaaggaacctatgaaaccttcgctgagctggcgcgacagcactttgggggcagcttaaaaggaacgttgacgctgacagcgggtctcggcggaatgggaggcgcacagccgctgtctgtcacgatgaatgaaggcgtcgttattgccgtcgaggttgacgagaaacgcatcgacaagcggatcgaaacaaaatactgcgatcgaaaaacagcatcgattgaggaagccttagcttgggctgaagaggcaaagctggcaggaaaacctttgtccattgcgcttctcggaaacgcagctgaggtgcatcacacacttttgaaccgaggcgtcaaaattgatattgtgacagatcagacatctgcccatgaccctttaatcagttatgttcccgaaggcaactcccttgatgaagctgaccgtttgcgtcaagacaatccagatctttacgtgcgccttgcgaagcaaagcatgaaaaaacatgtcgaagccatgctggcctttcagcaaaagggctctattgtatttgactacggcaacaatatccggcaagtcgcaaaggatgaagggctggagaatgccttcgattttcctgggtttgtccctgcctacatccgccccttattctgtgaaggaaaagggccgttccgctgggcggcgctttccggagatccggcagatatttaccgtacggatgcgttattaaaagagctgttcccgacaaataaagcccttcaccgctggattgatatggcacaggaaaaagtcaccttccaaggcttgccgtcccgtatttgctggcttggatatggagaacgaaaaaagatgggcctcgccattaacgagctggttagaagcggggagctaaaagcgcctgtcgttattgggagagatcatttggactgcgggtctgtcgcctctccaaaccgggagacagaagcgatgaaggacggaagtgacgctgttggtgactgggctgtgctaaatgcgcttgtcaacacggcggcgggtgcaagctgggtttctttccaccatggcggcggcgtcggaatgggctattccctgcatgccggcatggttgcagtggccgatggaagtgagctggctgacgagcggctcgcgcgggtcttaacgagcgacccaggaatgggcattatccgtcatgcggatgcgggttatgaacgtgccgttgaagtagcgaaggaacaggacattatcgtgccgatgcaaaaataaaggagtgatgacatgccaaagcaaattgatacaattctcatcaacatcggtcagcttttgacgatggaaagcagcggtccgcgggcaggcaaaagcatgcaggatcttcatgtgatcgaagacgctgttgtcggcattcatgaacagaaaattgtgttcgccggacaaaaaggggctgaagccggttacgaggcagacgaaatcattgactgttcgggacgccttgtaacgcccggcctcgttgatccgcacacccatcttgtatttggcggatctcgtgaaaaggagatgaaccttaagcttcagggcatttcatatttggatattctggcgcagggcggcgggattctgtctacagtcaaggataccagggcggcttcagaagaagagctgctgcaaaaagcccattttcatctgcaaaaaatgctgtcctacggcacaaccacagcagaagtgaaaagcggctacggcttggaaaaagagacagagctcaaacagttgcgtgtcgcaaaaaaactgcatgaaagccagcctgttgaccttgtttccacatttatgggagcccatgcgattcctcccgaatatcaaaacgatccagatgaatttctggatcaaatgctttcccttttgccggaaatcaaagagcaggagctcgccagctttgctgatatttttacagaaacaggcgtttttacagtcagccaatcccgccgttatttacaaaaagtagctgaggcgggcttcggattaaaaatacacgcagatgaaatcgatccgcttggaggtgctgaattagcaggtgagctaaaggccgtctcagccgaccatttggtaggtgcatcggacgaaggcataaagaaattggctgaggcaggaacgatcgccgtcctcttgccgggcacgacattttatcttggcaaaagcacatacgccagggcaagagctatgattgatgaaggtgtatgtgtcagcttggcaacggattttaatcctggcagctcgccgactgaaaatatccagctgattatgtccattgccgcgcttcatctgaaaatgactgcagaagaaatttggcatgcggtcacagtcaatgccgcatacgccatagggaaaggagaggaagccggtcagctcaaagtcggccgctcagctgatctagtcatttggcaagcctcgaactatatgtatattccgtatcactacggggtcaatcatgtacatcaagtcatgaaaaacggaacaattgttgtcaacagggagggagccgttcttggataagtacccttttctcagagaggccggatcttcgtttaaagatcgggatgtcacaaaaatgagcgacctgatcgcaacatgggacggccaggacattaagggaccggcgttaataggtgtccccctatcaaaatcctccatcagtcattcaggcgcttcctttgcacccggaacaatacgccaggctctgaaacattcatcagcctattctgctgagcttggagagcatgtcgtatcagagcttctatatgacctgggggatatcgatattcatgtcactgatatcgtaaagtcacatcatcacattttccaaaccatgcacgctctgctttcggaccatccggattgggtgccgctcatacttgggggagataactcgatcagctactccacaataaaagcgatagcacaaacaaaaggaacgacagcagtgattcaatttgatgcccatcacgatgttcgcaatacggaggacggggggccgacaaacggcacccccttccgccgccttttggatgaagagatcattgaaggtcaacatttgatccagctgggtatcagagaattcagcaacagccaggcctatgaagcatatgcaaaaaaacatagcgtgaacattcacacgatggacatgatccgcgaaaaaggactaatcccaacgataaaagagattttgcctgttgttcaagatagaacagatttcatttttatatctgttgacatggatgtcttagaccagtcccatgcacccggctgtccagcgattggcccgggcggcctctatacagacgaattgcttgaagcagtcaagtacatcgcacaacagcccaatattgccgggattgaaattgttgaagtcgaccctaccctcgattttcgagatatgacaagcagagctgcagctcatgttctgttacacgcattaaaaggaatgaaactctccccattcaagtgatcttctggcaggttgtattttgggtataagaaactcatctgccttaggaatggcagctaaaaggagggcgagacagtgaatcttcaggagaacagcagccaacagctaaaacgcacaatgaaaagcaggcacctatttatgatctcattgggaggcgtcataggcacaggacttttcctcagtacgggctatacgctacatcaagccggacccggcggtacgatactcgcttatgtaatcggcgggttgatgatgtacctcgtcatgcaatgtctcggcgaattgtcggttgccatgccggtgaccggctcttttcaaaaatatgctacaacatttatcggtccatctaccggttttatggtcggcatcatgtactggatcaattgggtggtgacggtaggctctgagtttaccgcatccggtattctcatgcagcgctggttccctgacagcagtgtatggatgtggagtgcgatttttgcagcccttctttttatatgcaacgcattttcagttaagttatttgcggaaactgaattttggttttccagcgtaaagattgtcaccattattttatttatcattttaggaggagccgccatgtttggcctgatctctttaaacggaacggcggatgctcctatgttgtcaaacttcacggaccatggcggattgtttccgaatggctttctcgccgtttttatcgcgatgatatctgtgagttttgccttttctggtacagagttaatcggcgttacagcaggagaatcagcaaatcctcaaaaggatattccgcgatccatccgtaatgtcgcatggagaaccgtgatttttttcattggcgctgtcttcatattatccgggttgatttcttggaaggacgcaggcgtgattgaaagcccgtttgtagccgtatttgcggagatcggaatcccttacgctgctgatattatgaatttcgtgatattaacagccttgctgtctgtcgccaactcaggcttatatgcttcgacccgtatgatgtggtctttagcaaatgaaaacatgatcagctcccgttttaagaaagtgacatctaaaggcattcctttaaatgccttaatgatcagtatggctgtatcttgtttatctctcgtttccagtatcgtggcccctggaactgtctatgtggtgatggtagcaattgctggatttgcaggagtcgtggtctggatgagcattgccttgtcccaactcttgtttcgaaagagatttttgaaaaaaggggggaatgtaaaagatctgacatttcgcacgccgctttatcctcttatgcctatagccgctctcttattatgttctgcttcttgtatcggtcttgcttttgatcccaatcaaagaatcgcacttttctgcggagttccttgtatcatcctttgctatctgatctaccatttcaaaagaaatgttacaaaagcgaaaaaaatcagccaagaggaatatcaggctgatcacatcctgtaatcaaaaaagcacaccccactcaggatgggatgtgctttatttttattcagtaatcaacgtatgaatcagcttcggcgccttcgcttccgcggcgatgcgggtgttgtcatagacttttgcgatgacttcatcaacattttcgcggttggcgtaaagcgtcacaagcggttcgcctttttctactttgtcgccgaccttcttgcggagcatgatgccgacggctaaatcgatttcgtcttcttttgtggcgcggccggcacctaacagcatcgccgcgacgccgatttcgtccgcaacgatttcagagacgacacccgcttctttggcaggcacatcaatttgatatgcggcttgcggaagcttagacggatcgtcaacaattgagctgtcgccgccttggtttttcaggaaatccttgaatttctcaagcgctttgccgtttttcatgacttcttccagcttcgctcttgcttcgtccaatgtatcggcttttttcgcaagcacaaccatctggctgccgagcgttaagacaagctcatgaagatcctcaggtccctcgcctttgagtgtgtcgatcgcttctttgacttcaagcgcatttccgatcgcaaagccgagcggctgggacatgtctgaaatgacagccattgtttgacggccgacgttatttccgatgcgtaccatcgctttggcaagttcagctgcgtcttcttctgttttcatgaaggcgcccgctcccgtttttacgtcaagcacgatggcgtccgccccggcagcgatttttttgctcataatcgagcttgcaatgagcggaatggaattgaccgttcccgttacatcacgaagcgcgtacagttttttatcagccggcgttaaattgccgctttggccgatgaccgcaaccttgtcgcggttcacaagtttaataaattcatccttcgtcagctccacgtggaagccgacgattgcctctaacttatcaatcgtgccgcccgtatgaccgaggccgcggccggacatcttggcaaccggcacatcaagagccgcaacaagcggagcgagaacgagcgttgtcgtgtcgccgacgccgccggtggagtgtttatccactttaattccttcaatggcagaaagatcaatcgtttcaccggaattcaccatagccatcgtcaagtccgcgcgttcacggtcactcatatcctggaagaaaatcgccatagcaagcgcgcttgcctgataatcaggaatgcttccgtctgtatagccgttcacgaaaaattgaatttcttcagtggtgagttcttttccgttttgttttttgatgatgatatctaccattctcatgtttggtcaccgatccttttcgattaagttcagtaaatcaagcccacaattgctgctgataaaaagctgacaagcgtagcaccgtataataatttcaagccgaaacgagcgacgacatttccttgcttttcattcagtccttttacggcaccggcaatgattccgattgaggagaagttcgcaaatgacacaaggaataccgatacgatcgctgttgtacggccgctgaaatggaaaccgttttgcgtaagcgacgtcatggcgacaaattcattcgataccatttttgttgccataatgcttcccgcattaacagcttcattccatgggataccgacaagaaaagcgaatggagcaaacacatatccaagaatgccttggaacgaaataccgaatactgcattaaaaatgccattgatcaaggcaataatcgcgacaaatccaatcagcatcgcagcgacgacaaccgctactttgaaaccgtcaaggatgtattctccgagcacttcgaagaaggattgtttttcttcttcctcaacacgaagcatatcctcttcttttgcaacctcgtacggattaataatagaagcaattatgaaaccgccaaataagttcaagaccagcgctgttacaacatattccggtttcagcattgtcatatacgcgccgacaatcgacattgatacagttgacatcgcagatgcgcaaagcgtgtacaagcgctgctgatttaaaagaccgagttctttcttcaaggagataaatacttctgactgccctaaaatcgcagaagccactgcgttatacgattccaatcttcccataccgtttaccttgctgagggcaaggccgatatatctaatgataaacgggaggactttccacttttgcagaatcccgatcagagcagaaataaacacgatcggcaagagaacattcataaagaatgtcgtttggtccgcattcaccaagccgccaaacacaaagttaattccctctgccgcgtattcaagcaggtaaccgaaaccttttgcaaatcctcctacgaggaaattccctatcccggtattgaggagaatgtagccaagaataaattgcaaaatgagcataacaacaattgggcggatcttaattctttttttgccgctgctcgcgatccacgcgaggcctaaaaacacgattaaaccgataatcccaatcaaatacttcatatgtgtttctcctttatttgtattcgcttacaatcactgtttcctcagaaaacggaaagcagtctgccttccgtcagctcttaatagttgtctccgtctgatgcattttctccttttacgatagaaacgcctgcgctggcgccaattcggcttgctccagcctcaaccattgtgtctacatcttctttcgttctgacgccgccagatgctttcacgccgatatcaggtcctactgttttgcgcattaaggcgatatcttccttcgttgcgccgcctgtagaaaagcctgttgatgtttttacgaaatccgctcccgcagacaccgctaaacggcatgcacgttctttttcttcatcagtcagaaggcacgtttcgataatgactttgacaagcgcttttccggctgcagcttccactacaccgcggatatcagcttccaccacatcgtcttccttgtcttttaaagcggcaatattaatgaccatatccacttcagtggcgccttttgaaatcgcgtcttttgtctcgaacgcttttgtttcagttgtattggcaccaagcgggaagccgatgaccgtacaaacgtcgactccagttcccttaagctcttttgcagcaagctccacccatgtcggattgacacatactgaagcaaatttgtatgttttcgcttcttcaattagttttagaatttccgctttttgtgtatgcggtttcaaagctgtatgatcaattatgttggctaatgacatccttcgcacacttccttttttgttaagatattttttagcataaccgacttttgaacatatgtaaattggtaattgaaattttgttcaatgaaaggtttgaacgtgtcacaaatcattaacaagcgccctcgcggtatgctggtcaatgattaaaacgttggcatattttccggttaatgctccgtgaatggaagatacttttctgcttccgccggcaactaaaatggagcgttccttcagtctgaggtcttcaagcccaacaccgatggtccggtcattgatggcgctgctgcaaatattccctttcgcatcaaaaaagcgtgaacaaatatccccgacggcctgttttttcagcagggctttctcttcttcgttaaaatatccgagccgaaacaacagcgcttcatcacggacagtcccgaccgtaaagagagcgatattcgcctgcttgcccatctcaataatccgctcaatatgacggtctttctccaccattcgcttcacatccgcattatcaaacacgacgggaagcgggagatagcgcggcatcgtttgaaaagcctctgcaaacagctgaatcgtttcagctgaatacgtgtttacccgggaatggctgatgccgcctttcagctggacgacctcgacgccttttacctgcttcggctgcatattttgcgcgatttgatacatggtagttccccagctgacgccgacaatgtcgccgtcttttaccgtttcatgcatatattctgcaccatagcggcttaggtcatgtgtaattcctgcataatcgggtgtcggggaaaacacaacatgcgcctcaaggagcccgtatttctcttcaagtatggaaccgagcgcatccaaatcctcaaaagggtccatgacgcgaatctggacataccctttttcctttgcatattgcagcagccgggaaacggttggccttgaaatgttgagctgctcagcaatttgctgctgactgtagtcagactgatagtaaagccttgccgcttctatgcttaattgttgtttttcccgatccattccgcacctccctgtggatcagtcctgataaaactgcttttgatttgcttttattatacaggctggcgccggctttcatccacctgatttctaagaaactgataaacgctctgggcgcggacctgcccagagcttatttctcccaggtcatatgctgataaatgcctttcataatggcgtacattccatataggatcaggcctaatgccaatatagacagaatcaatttgccatgcggctgctgcgcgagttcggcgagcgcaccgtcaaaacctcttgtgtcatcgggatcagcggtcatggctgtcttgatgagaaaatagccgatggctgagaaaataatggcgcgggcgatattgcctgcgcgcccggtgtttttcgtgatgcatatcatctgtttgttcatttttgatgtatcgaattctttcataaaagcagcccgaacgcctttcataaattgaacaatcgcaaatacgataaaacccgcacccgtaagccctgtgagccattggccgaatggctgcgccaatacataagcggaccacgtctgttctgaagtgccgccgtccccttggccaaacacaaatcgcaaggcattccaagcgatggatgtataaacggcggcactgaaaaagtttcctattctccgtgacaggcctcgcctgctgtttccgtgcccctccgtgtccttgattgcgcttaacaccatccagcttacatagccgataaggccgatgcctattaaaaaaagcaatagtgacccatacggcatgcgtgatagcgtttggagagctccgctcgaatctttggcgcggcctgccccggcagccgtcataaaagccaaaaccccaagcagaataaaaacgccgccgaatgcaaaataaccaagcctcccgaatcgtttgatccaaggcttggtttcctgttttatttttgacatgtaccggtctttcaccgccatgtgtccaaccctctttcacagaaatctttactgtaacattcccgattggacaaagttgaaacagcttctgcctcagctatggctggctgagatacatttttgctgtttagctgattgtgcaggtgtcatccaagcagccgctgcggcagctgtgactccgcctgctaatttcccaatgatcatggccgccgccatttcttttttcattccagccacaaaaccgagatggctgccgagtacaaaggcgccgctgaccgcaaacgcgacattgatgacctttcctctcggcgtcatatcctttaatgaagccagcattgggatatggtgcgccaaagaggtcaccaagcctgctgttgctgtctcatctaaatgaaggcatttccccagggcctgaagcggttttttgaaggtttttgtaataaaagcagtcattggaaacgcccctgccaaggcaatggcgatggtccctgtcgtttgtatccctgtctcgacattctccattcccggaatcagcacaatgccggtcatcgtttcaacagaaacagctgcaagcccgataatcgcaaccacactgaccgctttcccgaagagatgaaacaactgaatcatattgtcggtgtatcgccataacccaaaagcgatgacagcagataacagactcgggatcagaagatttttacctatcatgccgatgtcaaagcctgcgcataatccgccgattaagcaaccgatcggcactgtgcacagcccgattaatatgcctttcgcaaaatacggatgatcctctttttcgatgatgccaagagcgacgggaatcgtgaagacgattgccggtcccatcattgttcctaaaaacacccatgaaaacagcccggcctgcggatctttcgccatttctccagccagcgcatatcctcccatatcaatcgccaaaatggtgttcgcaaaggaagaagggtccgcgccaatcgctgtgtaaaacggagcaacaatgggaatcaggattgctgccagcacgggcgccagcgacacaattccgatcatggacagcgccagcggccccatagccttaaagccgtccgcaaactgctcgcctagcccccatctgtttcccaaacaataatccgccgctccccatagtaaagaggcagccaaaatgaatacaaccgcgtcattcaccgtcatggttttctcctttttcaaacgtatgattggttttatcatatcatctgaaatcattgaatagagctgaatcttattcaatatgagctaaaaattcttttatatcggctttttcaacggctgttataatgcgtcgcgctttttcttgcggaacagttaatatcaatttttcttttatgtcttcttcagacagctcatttcctggcgccccttttggacagtccacacgcgcttcgcaaatccggccgtctgataaataggcccggacaattgtgaaacggccttttggaacggcatggggagtcggctgagtagcattgtcatatacgcgctgaatatgccctattgtcgtttgaatgccgtttgggatcggctggctgttgaaatgttcaacggtcaggtcgtgtccatgcaaagcaagagcaatcacatattcaacgctgaaacggccttcctctccagtttttggagatctttccgtcaatgcagcatctccgcctggcggaaaaatcacttcaatacgttcggtattggccgcagaaatggtttcttcggagataagctgtcgtaccgcatctgcagcatggtgtgccgcggaacaaaatggatagattttaaaccatagacccggctgcacaattctccacggtgccccccaatcgtttagcaaagtatgttgtgctttttcaacgtcaccgtacagactgaagaaaccagtttctccatcaagtgccgtgcgggacccgccaaattctgattgggccagcttaacggccagcaagccagcctgagccgccagaccggcgtgcagcggtttcatttctgttccaaattgcaccctcatcccagcagattgcgtagccgcaaaaccaattgctttttccagcttttcctgagtcagctcctcagcataacctacggcgcaggcagcagcgatggcaccaagcgttcctgtattatgccagcccttttcatagtggcggctgccaattgattctcccagccgtgccatcacttcaacaccaacaacataagcgccaagaagccgctcgtcatgtccgcgagcggcagaagcaataagggccggtacgatgactgcactggggtgtcctcttacatcggagtggacatcatcaaaatccaatgcatgggcgataaatccattgagcatcgcggattgtaatggcgcggcctttttgccctgtccgataacaggaacaaggggccggcctccttcatcctctatcagacggaggagcttttgaattcctttatcttctcttcctgcgaatgaagcggcagtaaaatcaagtaatcctttttttgcttcgtgaatcgcgtcaactgaatgctcaggttgtgacgttctcacagcctctgcaagacctgctgtcagcccttgtttgctcatttgatggtctccaatacaataaccgccagctccgcaaagtattgagaggcaaccgtaagggcttcttcatccagtgtaaaggccggatgatgccactcctccgtcccgttcgttcccatccagacaaaaaatcccggaatcttctcttgatacagagcgaagtcttctccgcccggagactgctcagcgtgaacggtttgatagccaagccgtgccgcagcttcggatgccgcattcaaaaatgtgccgtcattctgaacggaaggcaaataaggaaaccacttgaattctgcttgtgccccatagcccgctgcaattccttcagccactcgtctcatatgctccggaacagcctgcctcgcttctttttgaaaggttcgaaccgtcccctccatttcagcttggtctggaatcacgttccacgacgtgcccgcctgtactcttgtgatactgacgactgcgttttgcagtgagctgatattgcggctgaccacagattgcagcccgctgatgatttgcccggctgcagcgattggatcaatactgttattcgggatgccggcgtgtccgcctttccctttgatgacgatctcaaaccggtcaacacttgccatgagcggaccttcctttacaccaatggtcccgacaggcagatccggcttattgtgcatgccgaaaatcgcggaaacgccatcaagtacgccagcttctatgacctttcttgctcctgcggcgatttcttctgccggctgaaagataaagcggactgtacctttcagctcggcccttctttgattcagcaacatcgctgtgccaataatagaagcagtatgaaaatcgtgtccgcacgcatgcattgtgccatcaaccttagatgcaaacgggagattcgtctgttcttggatcgggagcgcgtcaatatccgctcgtattgctatcacggggccgtcttcccgtcctttgatttctgcaatcacgccagtctccaattgaggaacatcaagtatttcgatttgctcctcctcaagccagcggcggatttttttcgtcgtttcaacctcttgaaatgacagctcaggatgttcatgaagatcacgccgcatattgattaaacaggtatgaaacgctgtgtcggccattgttcttctccccttcttatataagctctgcaggctctcccacctgcttgataaatcgtttcgtccgttcgtttttcggatggtcaaacagttcttctggcgttccctgctcgataatatggccgtctgccataaaaatcactttatcagcgacctcttttgcaaacgccatttcgtgtgtaacaatgatcatcgttgtttgcttttccgcaatggacttgatgacctgaagcacccctgtgacgagctcagggtcaagcgctgaagttggttcatccagcaaaatcgcatgcggattgaccgcaagcgcccgggcgatgccgattcgctgctgctggccgccggacattgtgatcggatagctgtcagccttatgctccagaccgacttgtttcagaatctccattccaatacgtttcgcttcgtcgcgtggtttatgttgagccacgattaaagcttctgtaatgttttgcagagccgttttatttttaaacagattgtagttttgaaagaccatggccgtttgctggcgaagccgatatgcttccttgcgtgtaaacttttccgcattcagtttggcttctccgatttcaataagtccttgatccggacgctctaatagatttaagcaccggagaagcgttgattttccggaaccggacggaccgatgattgccaccacttctccgcgtttcacttctagatcgattccgtcgagcacgacgagatctttaaacgctttgcgaatattttttactgttatcaactgatttcacctctaagtccggtatggcttgctcatggcacgttcaaacaagtcctgcaaaatgctgtagatcatggtaagaatccaatagacgatcgcaaccgccaagtacgtctcaaaatatttgaggtttcctgaagcgtacatcttcccttgggcgaacatctccatgacccctaatgtaaaggccagtgacgtttctttcaggagcccgataaatgtattgcccgttgccggaatcgcatttcggatcgcttgcggcaaaataatccgtctgtatgcctgaaattttgtcataccgacagacaggcacgcctccagttgcccgtcatcaacagaattgagggcagcccggaagatttctgccaaatatgctgcattttttaagcttaacccgatgatggcagctgtgagagctgtcattttgctcatctctggaaacagctgcggcagcccgtaatagattaagaacagctgcaccagtgtcggcacgcctcggaaaaaggatatatacagctttgacagctgatgaagcactggaattttgttctttgtgatgagtgcgagaataagtcctccgataatggcaaaaatcatagccgctatagccataaacaacgtgatcggaagggcctgaattaaagtcgggaacgctgatatcatgaattcccaatcaatcgtgttcattctggtgagtcaccgccgtttcttaatgcttctgttctactgtgatatcttcattaaagtatttttcagagagttttttcagtgttccgtctttacgcaattcatctagcgccttattgacttttttgcggagcttgtcgtgcgcatcgtccttggcaaatgggaatgcaacctgttcgtaaacaatcggatctcctgcaagctttaatggcaaaccggtcttcttgatttgcgcgatcaatacagttcggctgttgacataagcgtctacacggccgtacgcaacatccttcagcgtaccctcttgtgtttcgtacgttttgatattgatttttttatcaggatctttgctttcaaggtttttcgcgtggtttgaaccgagaacggctgcgactgtcttgccttttaaatcgtctactgatttgatgtctgtattgtctttttttacgacaatctgtgttcccgcataagcgtatggtttcgtaaagttatacgtttccttacgttcgtctgtcacagctacctggttagaaatggtgtcaagcttgcctgtttgaagctctcccatcagcccgctgaattcaagcagcttccagtccagtttcatgtcaattttcttagcgactgcttccatcacttccacgtcaaaacctgtcagctttccgttttctttataagcaaatgggtaactttgtcctgtcgcaccgacatgaagcacattgtcatcctctttactgctgctgtttccattgccgcaagctgagagcaccgctaataatgcagcaacgaccagcactgtccattttttcatcttcatttgattttcccgccttttctatttttatagatcatgtcgcaattgttttttcatatagactgtgatatgcccttttccaaggtcttgttcacctgagcggacatatccttttcgttcgtacatctcaatcagccacggatgcttatccgctgttccgagtgagacaaacggaacctttaacgtatcgcgaaggattgtttcctccagccattgaagcagctttgttccgattcctttttttccggtgtcggggtccacagcaaaccaccagatatgcggaacgccatacggtcccggctgttttccccaaggcattctcaaggtgatagtcgcgatgatccgcccgtcttcttccatgacgtagcaagcattttcccgaatatttttcagcaccaaatccaaatccgcatgagcggcagcaaaacgaatgccgagctttcgaatcggttcataagcccgcaatgtcagctcgagaagctgttcggcatcacgttcaactgcaaggcggtattgtggcttcatctagcgttcctccttactttgcatagcggtttaccggcttttccaaaccgaagtgctctcgtaatgttgtgccttcatattcttttctgaacacgccgcgcccctgtaaaatcggaaccacttgatcaacaaacacttcaattccttctggaagaagcggaggcatgatgttaaacccgtcacacgctttcgtatccacccattcctgcatcttgtcggcgagctgctccggcgtgccgacaaagatatggtggcctctggagcctgcaacgtatttgtaaagctctcgtatcgtcatattgtcacgttcagccatctcctgaacaagcttgaagcggctcttcaccgcattggaagcttctgcgtcaagcttcggcagcggcccatcaagcggatatgccgacaaatcaattccgcctaagtaattttggagaatttgcagaccgacagatgggataatcagatcttgaagctccttgtatttggcttgcgctgcttcttctgtatcggcaatgattgggaaaatacccggcatgatggcaattttttctggatcacgtccgaattccgcagcctgttctttaatggattgataaaattcttgagctgattccaggtggttttgtgctgtgaagatcacttcggctgttttggcagccagcgcttttccgtctcctgatgatcctgcctggataatgaccggctggccctgcggggttcttgaaacgttcagaggtccgcgaaccgagaaatattctcctttgtggttcagctcgtgcattttttctttgtcaaagaattcacccgtttctttattacggataaaggcgtcctcttcccatgaatcccaaagcccctttacaacctcgacaaattcctctgcccgctgatagcgcaaatggtgttcaaggtgcttttcaccgctgaaattcagtgctgttgattcaatagatgaagtgacgacgttccatccggcacggccattggagagatgatccaatgacgcaaactgtctggcaatatggaatggctcgctgtatgtagtggaggctgttgctgtcagtccgatttttgatgtgacctgcgccaaagcagagagcagggtgaatggctcaaaccttgttaatacatttggatgtgatttgctgtcaattgaaaggctgtccgctaaaaacagcatatccagcttgccccgctccgctgttttcgcaagctctttaaaataatccaaattcatgctcgcatctgaaggcgcgtccgggtgccgccaagacgcaacatgatggcctgtacctgctaaaaatacccctaatttgatttgtttctttttgcttgtcatgacgatactccttttatcatgtttttaggctgaataatccgaaaaataaactcctatattcctagtcgtttaatatgaataaatcaaaatgtacctttgtcttggacgtttgtcaatgagttaagattaaatttttctttttaagctgaaaactcgcgggatcatggggcggcatttgtgcaacctgtatactggcaaaaccagtctgatactgagacccgttttgatccaaagttttatataaatgtagcttgcaccttatctctacttccgaccatacgcattttgccgccacttttgctctttgctaataaacgcgcgtggtcgccgtcgtagaacggtccattttcccactcattcagaagctgagacatcacataaaaaataagctgatcccggattcataccgaaatcagctaatggaatcttaattaagttctagaatactttcttctgctttagcagaaaactctttaggctcaaggcggtctaggtcttcatgaaataaactcactttttggatttgccgattgtcatagtggtggaaatagtagtttccagtttcgttgcacatcacggaagtatattgcgtataatgaatttcgtcttcttccgttatcactgcgccctttggtatcgtcatatttgccaaaatttgaaaagcggctgttacacctttcgtttcatcggccgccggctctagatgttctttcaaataaacagctctgacaaaccgggaaggtggtgtataatcccccggcagaccaacagttcctaagccttggccaaaagcagaaagggctaatccgcccatctctttgctctctaattgcttcggtctgattcctgtatattgctgcagattggttacatgccatataaagtcggggctgttcgtcatgacaccaggttgattatcatagactttgaggccgtctgctctcggttctatcgtcaggcttcggcccgtccggtctgacaatatccagtgaagcggtaaaactgtatccaatagatctaattttttctctacaatcgttaaagatcgaatcttttcttttacgtcttccaaagacttacagactgacagcacccatgtcacaaactcatgcggggcaatgtgaacggtatcttcccgtatcgttttttcgtactccgcatagcccggaaaataaagcgccgcacaagataaaccgctttcattaacaccgtctgcaaataatatatttccaagttttctccccataccgataaacgcgtactgtgtctgatgggcctttccgtcagcttcactcttccagctgtaacggcgcggatagagaatgacctccgtccccagctgaaatgcaaaatccattgttctcgccaataaatgattccggtcagcagtttccaatgtaagacttgtgcacatttgatcagtccccttttcaattcagattaatatcatacatattgtgaacgaattggttttatcagcataacgaaagtcaaatcgattcgtcaaagaattgacattacatcaaataaaacgaaaaaatccagcctttagaaggctggattttttattatttagccaaaacaagctcgtgaatcgcacgcgcaacaccatgttcattattggagcgtgtttgaaagtttgctgcttccaatacttctgggatggcgtttgccatggcaaccccgcagcccgcccattcgatcattgtcaggtcgttcccgttgtcgcctatgcacatgacttccgcctgttcaattccaagcagctgagccagctggcgtacagcatttcctttgctggcttccgagtgcagaatttcataaaagaaaggcgcgcttctgaccattgtatatttttctctcacgtctttcggaatcgatgtaatgacgcggcttaagttctccggtttatcaataaacatcactttcgggatgaggatatcttttggcacctcgtcaattttgcggaaatgaagcggcacctgtgtcacataggattcgtatacggtaaattcgctaatgtcccggttaggcgtatacaaattagatgagtcaaagaaatgcatcggcgtcttcagctctaagctcaggtcatataatgaagtcaaatcatcataaccgagagacagctccgagaccacttcatttgtatgcgtattttgaacaagtgctccattatacgcaataacatagtcgccttcttcaattaaattcagttcatctaaatatctctgcacacccccgataggccggccggtgcaaagcacaattttgacaccttccgcttttgccgcgtgaagggcgtcgcggacctcctctgttacttcatgatgatcatttaaaagtgttccatccatatcaattgcaattagtttgtacatcctgcatctccttcatgtcgttttcaggctatagtcccatcatatcgttttttctttttgatattcaaccggaagagatggttttctccggattctgtttagacgccgcccttgtcttcggatacgaaagcgcggtttccgctttctttctgccttgacgccgttttctgcttttttctgtttcatcagcagaaagccggcagctagaaaaggaatgccggttatattcaagatggcaagcttcacacccgccgcgatgaaaaagaacccccatgaagatgatggattccgtctgatcatgacgtaagccgccatttccagaacaatcaggatggcatgaagcactatgccataaatcagcaatacaagggcaaaaaacaatacataattcacgattgcccctgagtacatcatagcgcgcatcatttgtataaacgataaggactgcatggagccgctgatgacattggggttatagatcgtatagtcactaaataaatgtttgactttgagaaaagcccataatataaatatccactgaataatatgtaaaacaagccccgctgccaccagtctttcagctttttgatttctcatctttctcctccctgccggtctttgattcgattcttgtcatcgtttttgtctggccattttgctcccatatcaatgtcccgttttctcctcttttcagcgtgcttttgagcggataataggggccgaggtactgaatctcgatagacccgtcagtgctttgggaaatcaccttgtatgccataaaaggcagctgtacctctcctcttccttccatcacttccgtttccacaacctcgtcttcggtaaatgtgactgttgctgatttcacaccgtccgttggcccgggggcacgcccctcatcccacgttccgtaataaaacggcgtctcttctttttgctgctggcagcccgataccatgatgcatacagcaattaaaaacaaaatgccatatttgtttctcaaggggatcaccattctttcctccttttttgggcgaatgccgtgccactgtgccaatgactacataagttataaggaattcacccacaaggagactgatcacatgaacccttatcaatattacagccctcagctgcctcagcaggaaccttactatagccactatgagtacaatccttatccgcagcaggatgtatacgatccataccaaatggacagacaaccggcattggaaagaagaatcgcagcacttgaacggcaaaatgaacagcagtcaagagaattaacccgtctgacaaacgaagaccgccgtcaaaatcgggaaattgcacggattgccgaacaggtcaatcagttaagccaggctgttgaacgccatacacgccgcctaaatcggctcaatcagcgcctccgcacagtagaaaacaggctgaatatcccatttactgcaggggaaggcggtttctgagcaaacaaagaaaaaaagcggaatacgattctcccatttcagggtttcgttttccgcaattcttatatgttaaaacggaacatttacataaaaagggtttgtacccagtatacaatctttaccgttttcattcaaagatagaggggctgaggaaaataattgtagttcctctttgacggaatttcttttcattcaagttgcatgataataccgactcacgtcaatcgatacatggagggatcattcatgcataatacacaacacggcttgcagcagctgaaccaatgccgccaaactgctcagcagctcattcagcagacacagcaaagcagccagcaatatcgccaaatgcttcatcaggaacagcaaaacatccaaatgctgcagcagattctaaaccacgaacaacaagctgcacataccattcagcaagcactgcacgggcatgatatggcgattcaaaagtgccagcaggttgtcaacatgtgcaaccaaatgcaacaggaacttactggacaatccagcgtcatgaatacgaatgtgtctacacttccattcggccaaaacacgccatttcagcagcaatcctaccagcagtaacatataaaaagctcaacacaatgcgagtgttgagctttttttcttactgttctttgcgaatatgtatatcctgaatagactgtttcggtgcatgaaatctgctctcggcttcacttcttgcctcggcaaaagcccgcgcctccacatgatctttgtagacatccagctgaatcaaatacagcgggcgcactttaaatccatgaataatggtcaccgcccataacgggaccacaataaaaacaccgggcagatcgggcaaaacaaaaccaaatgcaaaaatgaaaaaataaatgatgccgtacatgatccactttctatttctaaccttgatgccaataaataaaaaggcaaaaaaactggtaatggcaaaaggcatgaaaataaacagcatccaccagctatgcagccattcccaagcggcacctctttttgtaattcccatatttttctcctcctatttacctataataatcgattaggcataccgcgtcacccataaacgggaaaaactttctcccttaaaaatagtgatagacggagaacaggtttcttgctatattattaattgataatgataatcattactaatctattgagatacatagtgggagggttcttgatgaaaaagaacatattgctcgtgggcatgcttgtgctgcttctcatgtttgtcagcgcttgcaacggcacggcttctaaagggagctcaagcgattctgcttccgaaaaaacagaaatgagaacatacaaatcaccaaaagggaacgtcaacattcctgcacatccgaaacgcatcgttactgatttttatgccggtgaattgctgtctgtcggggccaatgtggtcggctcaggctcatggtcatttgataatccgtttttaaaatcaaagctgaaaaatgtgaaggatgttggtgatccaatcagcgttgaaaaagtgatggagcttcagcctgacttaattgttgtcatgaatgaagagaatgttgataaattaaagaaaatcgctccgactgttgtcataccttataacacagcgaaaaacgtagaagacacagtcagcatgttcggagatatcgccggagcgaaagacaaagcaaaatcctttatggatgactttaacaaaaaagcggaagcagctaagaagaaaattgccggcgtcatcgacaaagatgcaaccttcggcatttatgaaaacacagacaagggcgaattctgggtgttcaatgacaatggaggacgcggcggccaagctgtatacaatgcacttgggttaaaagcacctgaaaaaattgagcaagatgtcatcaaaaaaggagagatgaaacagctctctcaagaggttattcctgagtatgccgcagattatatgttcattacggattacaacccgaaaggcgaaagcaaaacactcgacaagctggagaattcctctatttggaaaaaccttgacgctgttaaacataatcgcgtgtttatcaatgactttgacacgttctacccgtacgacccgatttctgtcagcaaacaggtggatatcatcaccgacatgctgatcaaacgggccgaagaaaataaaaaataaaaaaacggcacagtcatgacgctgtgccgttttttatgattcactttaattttgactgtacggagtccggcatatcttcaaacttgacttcttcccaagtctcgacatactttcctttcgccttcaccttcaaatacgcgttcttccgaagctctttgccggcgaaaaaggtcacttcttcttttttcccggatgcattatatccgtctaatgtatattcagtaccgcccggactaagatgtctgccatctcgatcaatctgaacatagacatcttgctggtgaataaacggattaaatctgtctgtaacatcgttatgaaaaaagagaagcccgcatattacggcagcagccgccaagacggccaggattgccattgcttttttcatctttgcactccccttacttgttcatttttttcaaatagcttgaccgcaccgcgaggaagaatagaagctgaaaaatgaaaaaccctccgatggtgagactgagcggccccgcgacatcagaatagccttccacagccaatgttctcaaggcaaacagtgtatgcatgacggcaatgacaaatggaaagaagaaaagaatcgccaattgtattgtcacgctttgcgccatttctcgctcactcaggccgattttggccagtgaacggtagcgctcccggtcttcatctaaatcagtgaacagcctgaaatataagaaacttgctgctgcgacaaagaatacaattgcgataaacaggccgataaataaactcaggctcggcagctgcaccgtatcatagtaagtccccgcttttgaagcaaaatcagaatgcacgtcgatataattgccgtaaatctcattttgcaaggattggctgatctcaagactgtctttccaatgatcatagctgtagccgtataatgacgctttatcaccgagtgatttcagctgatcaaaggtttgatcattcaccgcgatgatagcattcaatgagatcagcggttttttgacttcttttaccgacagtttttgatcagacagctcccctttttggttcagcagcttcagctgatccggcgcttcgtttttgaaattgcggtcatacgttcccgggaaatagacagcctcgtcttctttcaagccgttcactttgacatggaagtattttgccgcatccgattcactgatcatgtaaacagggggaacagtttctccttcctgatagcgaacataggaaacatctattttgtctttcgtatacgtaaaaccgtgtgttttcagttcatggtcaatatctttcaaatgagtctgttcttttggattgttgctgtaagataaatactccatttcataagcggactcttcggctccgacggtcgatttgtacattgcgagcacgcctgtcgcagtaaacgcaaccgcggaaataatgctgacaataaagaacaggcgggcgttgtcttttagacgatagacaaggtcagaaacccaaatgatgtttttcccgcgtagataaaaggttttccacttcttcagcgcgcgcagaatccatatgctgctttggctgaaaaagaaatatgttccgatgacggtgagcagtaaaatgataaacggttcggccccgtggacattgcctttaagaaccatgccgtacccgccgcacagacaggcgatgccgaataaggacagaagcacggacggcttaggctccggtttaaccttgccagtgccctttattaatttgataaccgtatttgatctgacaaaaaggatcgtaaactgcgataaaaagaaaaataagagcagaaatccgcaggccgtaataccgagcgctttccaaggcatatacaaaggcagcgcgtccatttctaaaatataagcgccgaccgtaaagaacgtctttgaaaaaatgaatccaccgattatgccggctgcaattgacatgacgccgataatcatattttccgcagtaatgagctttctcagctgccccggcgtgatgccctgcatgagcagaatgccgaattctttatttctcgatttcaaaaatgcattaaccgaatacagaacaaataagaaagaaaaaacaaagatcatccattccgcggcggttaagccttttttggcgatgttattcaggtagccttcctttaatgccggatgaaacaggaacatcgcaaaggtaaagaaaatcaaaacggaaaaggcgctgcttaaaaagaatgcaagataggcccttttgtttctcgtgacgtttttataagcgaactgaagaaaggtcatttgcgtttccccccagcatagacagcacatcaagaatttgttcataaaagacttggcggttttccccgcggtaaatctcattaaacaattcgccgtcttttataaagatgacgcggcggcagtagcttgccgaaaccggatcgtgggtcaccatcaaagccgtgacatgatcatccctattcaggctctgcaacgtttccatgacgtcttttgtcgctttggaatcaaggtttccagttggttcatcggccagaatgagtgacggcttatgaatgaccgctcttgcgatggcggcccgctggcgctggcctccggatacttcaaacgtccgcttgttaagcaggtttacgataccgagctttgccgcgatgccgtgcagtttttcttctattacagacggcgcttctttttcaagcgttaacggcagcatgatattttcaccgatcgtcagcgtgtccagaaggttgaaatcctgaaacacaaatccgagctgcttgcggcggaaatgagcgagctttgtccgcttcaggcgatgcgggttttctccgttaatcaggatatcgcctgaatctggacggtcaatcgttgaaatgatattcaaaagcgttgtttttccggacccggacggccccatcaccgccgtgaactcgccttcttctattgaaaatgaaatttgctttaaggcctgataggacacttgtcctttataggttttatttatatgtttgacttcaagcatattcgccatgaaaatcctccttatggttttattcttgttgatctgggctgctttcatgtagtgccgggacgttcaacataaaaatccccttgacataaatccatgttatcaaggggaaacaaagcgggctatgttgttttcttaacgcagccttacatttttgtaagaaatgaaaatcgaactgatgtcccttcaccgggagacgagctgatgtccaccgtatgattgagcttatctgtaatttctttgacgagatggaggccgattcccgtagattcttggaaacgccgcccgttttcaccggtgtaataagggtcaaacacccgcttgatgtcttgcgagggaatcccgacaccgtaatctttgacttcaagcaccgtcctgtcttcatcgcggaagacattcagctcaagtctgtcactcttgcccgctgaatacttgaccgcatttgtgaccacttggccgatcgcaaatttgagccatttggcatcggtgtaaatctgatgatcatcgcaaacgttcattttcggataaacgcgatattgaataaaaaatcgtttatagctttgaatgactgattggagaagctcggacagggaaaccgcttcgattttaaaatcccgttcaaacaggtcgagccttgaagaataaagaagcgtctccagcccgaattcaatctgccggacttcttttttgatttgttcaaaaacgggctcatcctcttcttgaatgattaaattaatgaccgacagcggcgtcttcacttggtgcacccattgattcatatacgtcacccgcgcgtcaagcttggcttcggtctcatggagcttctggtgctgcagccggaccagctccatctgcttttcatacagctctgaacagaacactgaagaaccgagatacgggatatccgtcccttcctgccccgagctgagccaatgatacacgccgcggtctttgtaccagcgataggcaagataacccgccaaaataagaagctgcacgcccaatatgtaaaacaagtgagaaaaagaatgcagacccgcaaaccagtaataaaagaagacaaacagcccttgaaggaaaaaaagcagaatcagcactgcatgagaccggagaaacagcttcatgactgcgccctcagctggtagccttcgccccgcaccgcttcaatagaaacaggcgcattcagctcccgcagtttttttctgagccgcgtgatatacacgttaagtgtattatcatcgatgaatatgtcggtgtcccacgtcttttccatgagacggtcccgactcgtcaccttttctccccgctcaagcagcacttccaaaagcttgctttcttttttagaaagctcgcttttttcatcctgaaaatgcagttcaaaccgttccacaaagagttgaacgccggcatattcaaccactttctctccctgctttgcggcgtactccccgtacgccctccggatctggcttttgattttcgccagcacaatatcataagaaaacggtttttcgatataatcgtctcccccgttttcaatcgccatcacctgatccatttctccgcttctggcagaaataaagatgatcgggcttgtggagtgctggcggatctgccggcaccaataatatccgtcatatgccggcaaattgatatcaagcagcaccacatcgggcttttcccgcaaaaagacatcaagaacagctgtaaaatccgcggcgaccactgtttgatatccgtatttttcaaggtaattctgcaatagtccgcgaatgtcttcactgtcttccacaatcataattttattcaaactgaaccactcccgtttcttacactgctgccatcatcataatcgttttgggcgtatggacgcaacaccgcacaaaaaaaccgccatctcggcggtttctggtctctttagccgacctgctgcttagctgctttaccggctgatccgaactctctcattttgcttcgcactgtctcttccacggcttcaatgccgggtgtcaaatagccgcgcggttcgtacagatcgctgttttcctgaaacatgcggcgtgtttcgtctgtccacgctaccatacattccgtattgatattgatcttcgcgtggccgagcgtgatggcttttttgatctgatcctgcggaatcccggatgccccatgaagaacgaggggaatatcagtcatgcgggagatagcctccatttccttaaatccgagattcggctcaccctgatatttgccgtgtacagagccgagggcggcggccagcgcgtcgatattggtttctttaacgatccgctcacattccgtgatatccgcatagcggaccccgccgaccagtccgtcttccattccgccgaccgtgccgacttcggcttctactgacacgccgtgttttgcggcataatcggtgacttcttttgtcatcgcgatattctcgtcaatcggctgatgggagccgtcaatcatcactgagctgaatccggcatcaatggcctgtctgcagcgttccgcactactgccgtgatcgagatgaagcacgaccggaacggtaatcgccatgtcctccattaacgcgcctaccatggcagcaatcgttttaaatccgcctaaatagtcgaccaggcgatcggaagccgcggcgatgaccggtgattgctccttttgcgccgcctgcaaaatcgccttcgtccactgcaaaccattgatattaaactggccgatcgcatactgctcccgctttgcatcttcaagaagctctttcatcgatacaaaagccatgtccacccctcctttatccattacatgttgaagtattttgatacgacatcaaccgttgttttttttgctgtttgaatggcttcctcagcagtcagcttatagtattcaggccggaagagctcaaccgatacaacatcagagaagccgatttccttcagtgctgataagtgggcatctaagtcaattgccccttgtcccggccatacacgatcctcatctgttaaaaagccgattgggaaatcttctgtatcatcaatatgatagatgaagattttctttccgtccgcctgctttaagctctcaatatttgaacccattgcatggaagtgaaaactgtcaaggacaagcccgacattgtcacggttaactgtgtttacgatctcatacgcctgttcaaacgtattgaccgtacattgcggatggccgacaaattcaagtgcgatttttacgccgtacggctccgcgatatctgacagctcagtcagcacgtctacactgctctttttgatctcttcttttacaatcttctgctctgtcacaagcggaacggccaccacatatttcacaccgagggttttgcatgtttccatcatgcctttaaattcagtgatgatctcgttgtggcccttttcatcacggttgttgaagaaaacaagcgcgtttaaagcaagcggtttgatgtggtgggtttgaaaatattccgcaagatctgccaatgaatgatcttttaagtactccggcagcttatccattgtacggatttcaatatagtcatagccatgcttttcgcatagttctaaatccagtttaaggtttgaattttccaatgttgtcgcttcattaaaacaaagtttcatgccagactcccccatctgcgttttagatatgaagggagttcgacaggaaggctgtcgccatatcccgccgaactccatgctcagcttatgccagacctaattcttctttcattttcttaagcataaatcggcttgattcatccgctctttcatcgacccaagcaaatacggcattcgtcgcaattccgtcgaacttcatctctctcagttttctgaaaatcgtatcaaaatcaacctcgccttgaccaatgtccaaatgctggtgaaccgttactttcgcgtcaggcggattgacgatatagcgaagaccatgagccgctttatgattataggtatctgcaaataaaacatgtgtgaggcggtcgccggcttcgtcaaacatggtctcgatgtcgcctttgccgtcatcatagaagaacgtatgcgcagtcgagtagacaagattgatccaatccttgtcaagcgcgcggatcatatccatcgcacctttgtgcgtttcgataaaatcgtatgggtgggcttgaagattaagtttaataccttctttttcaaagactggcagaagctcatccatggatttgataaatttttcttcacttgttaaaggatcatattttgaaccgctgaattcgctgttcatcaaatccacttcaagttcaaccgcaatttcgattgcccgtttccaattgcgcactgctgcctggcggcggtcttcatcaggacccgcccagtggtaaagaggaagaagcgatgaaagcttaacacctgtatctcttaaaaggcgctttaattgtttgatctttgctgaatcgactttcggatatttataaaacgggcaaaaatcctcgcgcggagacaattcgatatattcatagccaagctccgccgttttatagaccgtttcctctaaagttaaatcatcacgatacatggatggatccaatgctaacttcatattttcactcctctgttttttaattttgaactgttgtaaaagattgatagaattccggtttttccttcaattcaaccttttctttttgtccagattcctgggcttttacacatgcatcagtcgtgacagcagcaatatagccgtcccatgccgtcggtccgctgacctcgcctttcttttgaatcgaatcaataaagtcttggatttccacatcgtacgcagcgacaaagcgtctctgccaatccatcaaaatatctgtgctgaatttgccttcttttctcaagctgatgcttgatggttcaggaagcttgatgatgccgtcttctccgacgatttcacattgaatgtcatagccgtatttacagttcacatagatttcagcattgatgacgataccgccttttgtttcaatcacgacgatttgcggatcttttaaatgcggcagcgcgtttttcgattttttcgggtagatgacttgaacggactcgtagtcatcgctgacgagccagtgcagtacatcaatttcatgaacgagcgtgtcgactacggccatatcggttgtgtagttatctcctacagtcgggttgcggtgcgcgcagtgaatcataagcggttcgccaatcacatggttatcgagtgcttccttcagctgtacgtaaccgctgtcataacggcgcatgaagccgacttgaacaaggcgtttgcccattttgatttcttcttcgacgatgcgcatgcatccttcagccgttgtcgcgagcggtttttcacagaacacatatttctgggctttaatggctttcagcacgcttgactcatgcgcaggcccccagcttgtcactaagacagcgtctacattttcgtctgcaagcaggctgtcatcattcggataaaccgtcgcgtttaattggtattgctcaacgaccttttgtgcagcttcttgattaacatccgttacagctacgatttctgcgccggacagcttgttcgtgatgcggttaatatgttcttttccgattgctccagttccaattacgccaatacgtaaactcattgacagccactccttctgttgattacataattttgctttctgtttcttgctttacttggctctgaggagatccgtagagttcctcttgaatttgctcaagcgacttgccagacgtattcggcgcaaagagcagcccgatgatcatactggccgtcacacatccgagaagaattgcagccatcgttccaatgccgaaattggtgataatcattgggacaaacagactccaaatccctattgaaatacggacaaggaaaaacatcagtccttgtgcggaagcacgatattgcgtaggaaagatttcgctggcccataactgatagttcgcttgctgcccggctccgttattgatgccgatcacgacaataaacaggagcagaatcggcaggccttcaactggcagcagaaacagtgtccacccgatcaccgccatgaaagcggcgattccaaatacggtttttctatatttgtcggcaaagggcatgaagatcaaagcgacccccaatcctgtgaagataaacagccccatttgcaaaaggttggccatgttggcagatacaccgccgacctgctgataaatgtatggcataaagaagcccatgaccccggcggctaagttccaaaccaaatacacacccatcaaaaacagtatgctttttagatacataggcttgagcaaatcaaaatacgatgtcttattcaatacagccggcttctctgcctgagcttcctccggctgattttttgtctgccaggcgtctgattccggaagcctgattctcaggatgtacgtaatcagcgcaatcacaagcagatgggcaaatacgattttattccccaagagtcccaagtcaccggccagtacggagaggagcagtacaacgacagcgcccgcggcccaagcgacttgtgctacgccgcaatgcctggcccgattcttctttggcgcattttccgcaataatggtccatgacgcggttatgtcagcccctactgataaaccgataatgatgtaaccgcttaacaacatggggaaattaaccccgaacaaaaccaaacaaatccctagtgcataaaccagcatactattggtataaacagccttccgtccgactttatcagccagaaacccgccaagcagcgcgccgacagcggcagaaatcgcatttgcgctcagcgcgccgagcagcccgatttgcgtatcagatagcttaaggtaactgacccataatgataaaccggcggagcctgccacaattgaaccggcatcaatatagttggccaatgctgccgcgattgtccgtttattgaaggctgaatctccattggtattgcccatatgttcattccccattaagccagatccaacaactgctgatcaatatagtttctcgcaatcaatgcatactccagcgggtttgcaacatctgggtcctgttcagcttcaatgacaatccatccggaataactgtgcttcaacagcagctgatatacttctctaaagtcaatgcagccgtcaccgggaaccgtaaacatgccttttaaaaatgattgccggaacgattgtccttcgagcctgcattgttccatgacattcaggcgggcatccttaaagtgcacatgcttaatgcggccgatatgcttctcaagcatccccatgtaatcgccgtcagaaatatacgcatggcctgtatcatagaggaggtgtacatgcgcagggtcagttcctgccatcaggcggtccacttcttccgctgtttggacaccagtgccgagatgatgatgatagacaagcttcaagccatgctgagcggcaatttcgccaaggtgattcagcccttcgcaaagccgctcccattcatcatccgtaaagtgcggcttctctgtgaacacgtttttctccaagctttgcacgctgtacgtttgttcagagacaactgcgacatccgcgtttacttgctgcaaatactcacaatgcagggtaaatgcctttgccgcttcaccaagtccgtcacgcaaaataaaactgctgaaccactttcctgcaatgcgtaagttccgaagcttcagctctttgttcaggatggcaggttcggggaaaaagcccccgacttccgtgccttgaaaacgtgcgacaacgatatcacttaacaaatgctgaagtgtatttcccgctccaatttcaggcatgtcatcattccgccacccaatgggagcgattccccacaggatttcatttttgcccatctatggtgcctcccctctaatactgcttcgcagattccagctttttctcttttgcttcgtatgctttctgaacgctttcttgttcagatacctctgccactccgacatgccaccagctgtcatagccgtccgtcattgtttttggcagcaccttcatttcaattaatgttgatacatcctgtttcttcgcatcctctaacgtcgcttttaattcttctactgtgtttgcgcggtaggttttcgcgccgtatccctcagcgactttcgcgtaatcgacattcaggatttggttgtcatctgttcggaactcgcaatagtagctgccgctgccgtgatccatttgcaggttgttgatgcatccgaatcctgagttgtcaaagagcagcacattgattttcttgttgtactgaatcgccgtgatcagttcagaatgaagcatcaggaagctgccgtctccaacgattgaatacacttctctgtcagggtgggccagtttaagaccgagtgtcccggacacttcatagcccatgcaagaatatccatactccaggtgatacgtattcggaacattagaatgccacagacgctgcaaatctcctgggagtgagcctgctgaacagatgatgacgctgtcttcaggaatcgtctcgttgattgtcagcaatgccgttgtttgcggaagctccgtattcaacgcgtcagcatattcattcaggacctcttgagaaaagtgatttttgatttccggatcaaatgcttcccgcttaaacgtcactttgctgagacgctcgcgttcagctagccattcgtccttcagctcccggatcgttgtgccgaactcgctctcatagccttcaagcaagccatgcagtttgccaagcgtcactttcgcatccgccaccacttggaatgcatcaagtttatacgcctgcattcggctgacgttaatgttcaaaaacttcgctttatcaaaatcaaaagcggtcttagaggatgtcgcaaaatctgtataccttgtgccgatgccgataatcaaatcagcttggcgggccgctttgtttgccgcaagtgtacctgtgatgcccattccgccaaggttgtttgcaaaatctgcctcaacggtagactttcctgcctgcgtttcaactagcggaatgttataggcttcagaaatggcaaccaattcatcgcgcgcaccggaatattttgcgcctccgccgacgagaatcacaggttttttgctggatttaatcagctccgccgctccttgaagctcgcgctcgctcggctgcatgcgatcaatatagtgaacccgtttgacgaagaaactttcatcaaaatcgtatgcttccccttcaacatcctgagaaatacaaatcgttgccggacctgcttttgccggatcagtcatgacttcaaacgcgcgcagcaaactgctcatcagctgctcagggcgcgtaatgcggtcccagtatctcgatacaggtttcaatgcatcgtttgtcgtaatcgccgcgctgtattcttgctccatttgctgcagtacagggtctggctgtcttgtcgcaaatgtgtctgccggaatcaagagaactgggatattgtttgccaatgcagtgccggctgccgccaccaagttagccgctcccggtccgacggatgtagacaccgcatatatttttcttctcagcatttgcttgctgtacgccatggccgcatgcgccattccttgttcatttttcccttgatagactttcaaatggcctgcatcctgctcaagcgcttgcccgatccctaatacgtttccatggccgaaaattgtgaaaatcccttcgacaaaaggctcttcctttccatcaacatggatgtactgctggtttaagaatttaatcagcgcctgcgctgttgttaagcgaattttcttgcccacaaacgatcccacctttactcgatctttttcaattatgactgtgcttcaataagctgtacgatttcttccgcagtcggcatcgcttctgacgaactgtgcttgctcaccacaatggaagctgaagcactgccgtatttcaatgccgtttcaatgtcttttccgctgacaaggccatagataaaagctgacgcataggagtcaccagctccaaaagttttcagcacttttgtcttgtacgcttgggcgcggaatacctcgccggatttgctgtatgcgtaagagccttcgacgccgtgtttgatgacaacgaggtcagctgaatggccaaataaatgattgacggattcttcattgcttccgcctgtgcggttttccatcacatcaaattcatcgcgtgtgccgatgacgatatcagactgctcggcaaccaaagaataataaacggctgtttcatctgatgactgccacgtatacgggcggtaatccagttcgaacaccactttaacctgatgcttcttcgcgtattgaacagcttttaataccgcttcccgtgacgggcttttggcgagcgctgtcccggaaacaagcagcattttcgcatttgcgatatagtcctcgcttacctctgaaggctcaagataaagatccgccacatcatcgcgatacattaaaatgctgcattcttcagggctgaggatttctgtaaatgcaaggcctgctttgtgtccatcttgatcaacaaccatctgtgttgtatcaacgccggtctttctcatataggactctatgaatcttccatgctggtcatccggaattttgccgatgaagcccgcttttaagccaagcttcgcgctgccgatcgcgatattcgcaggtgaaccgccgacgtatttggaaaatgtcatcgtctcttccattgggcggttgtattcgactgcgttcaggtcaatacatgcccggccgatggcaataatgtcaaaagccttctcttcattgaatgtatacttcatcgtaaacagccactcctcacttgttagcgttctaaaatccactcatgcgccgggtcgttatgaaacttccattttcgcgtcggccctgccatgacatttaaatagtaggatgtgtatccgtccggaacgcctaccgggtggtatcccgcaggaacgatgacaacgttttcattttccacagtcattgtctcgtcaatagaacggtcatctgtgtatacgcgctgaaatacaaagccctgtcccgggtctaactcatggtagtacgtttcttctaagaaagattcttccggcaagttgtcttgatcatgtttgtgaggcgggtagctggaccagttgccgctgtctgtatagacttcaactactaatagactgttagctgaagggtctgaatccggaagaatgttatgaacagtacgtttgtttgaaaattgcccgcgatgttcaattccgttgtcttccgctttgatcagctttgtcggaagctgcttttccgatggagaatagcaaagcgccactcttgcgtcgctgaccgctgtgatctcaaatgcacggtcatttgacatatagacgctgtctgtcggttttcgttcaaatacgctttcacgcgtgccgatattctcaaaagtcgactcatgatctgtcactgtaatttttcccgttaccgccacaatacagatttcttgttttttcaattcttctgtatagcttgaacctgatgcaagatctaacactttaaactctacataagtgagatcagagttggatgtcgttacttcgtgcacgagtttgaccccattagacacttcatgcgactgcggcttacgcaacaaataactcatagtgaagccctcctctttctattggcagaatgagtccgaacagcgcacatggacgccgttcggctgttcgtcgtttagttgaaatcaggtgccggatatcttgccgttaccacttttttacgtgtatagaagtcgacgctgtcttttccgttcgcatgcagcgttccaaagaatgaagatttccagcctgagaatgggaagaacgccattggagccggcaccccaaggttgattcctagcattcccgcatcaatgttttcacggaagtagcggattgcgtttgagttggatgtgaacaagcaggcgccgttcgcaaactcagacttattggcgatttcaatcgcttctttcaggtttttcacacgaatgacagataagaccggagcgaaaatttcatctttccagatcgtcatctctgttgtgacattgtcaaagatcgtcgggccgacaaagtagccgtcgtcagacacattttcacgtccgtcacatacgagtctggcaccttcttcaagacctttttcgatatagctgagcgtgcgcttcttgttgtcttcgcgaatcaccggtcctaagaacacgccgtcatcaaggccgttaccgattttaatgtccgccactttttcctgcagcttcgccataaattcatcggcgattccttcttcaactgtcacaaccgcacaagccatgcagcgttcaccggcagaaccgaaggcagctccgacgatgtttgtgaccgtgtcttcaagattcgcatcgttcaagacaatcgtatggtttttcgcgccagtcagagattgaacgcgttttaagttttcgcttccttttttgtagacgtattcgccgactggcttggagcctacaaatgaaatcgctttaatttcgggatgctcgaggatgccgttcacaacgtcatgcgcaccgtatacgacgttgaatacccctttcggaaggcccgctttttcaaaaagctcaaccaatttctctgttaacagcggtgtccgctctgatggttttaaaataaatgtgttgccgagtgcgatcgccattgggaacatccagcaagggaccatcatcgggaagttaaatggcgcgattccgccgacaactccgattgggtagcggtagttggccgcttcaacgtccgttgcgatggaagcaagcgagtcacccatcattagggaaggtgctccagcggcgaactctacgttttcaatcccgcgtcccacttcacctaaagcttcttttgtgttttttccgttttcaatggtaatcagatgagccagttcttctttatgctgggacagcagctgctggaagttaaatagaattctggcgcggcgaggaaccgccacctttgaccatgttttaaatgcttcagcagccgtttgcgctgcgtaatcaatatcctcttttgtagaaatcggcacttggcatagtacttctttcgtcgccggattgacgacatcttcatattgatctgttttgctttcaacccattcaccgttgatgtaattttttaattttctgatttctgccattcttattgcctccttcattagtaaacacatacacttgtatggatggttcaggatagattcatatcaatatccacttttcagcaagccaagaattaaacgctttcaaaaacaccaaaaaaataaaaggcggatgcatatttacatacaagcaaccatttcatgcacaacaggttactttttggtcatttcttggttatattctaatcgcataatacccataagtcaatcataaacactaaattttttcattatttttattatattaatcttttaatcaagtaagagaggtaagagaaggccgtagaatcttgcaaaagatatacaccgatgttatcattttttaagcaactattgattaacttttggtttttattatatatttatgttacgtaaagattcaagaaggagttttttatatgaaactgatgcggattcaggaaatggaggagtacattttatcgcatggcactgtttccttagatgagctgtgccaggtgttcaatgtctccaaaaacacagtcagacgtgatatcaacaagctaacagaaaagggtgcgattgaaaaagtatacggcggcgtaacatctattgaaaaaaccgcattagttccttttgaaaatcgcaccattcagcaccaggatgaaaaaacaaaaatcgcccattatgcttcccgatttattgaagatcacgatttggtcttcattgattcaggaacgacgacaaagtctattcttgatacgcttgatccagccaaaaatgtcaccatcttaaccaacagtttagacattatcaatgcggcgtcagctttgaagaatatcaacttaatcattatcggaaacaactataagagaaaaacccgctcctttgtcggcatggacgacccggctatgcttgataagtacaatatcaacaaagcctttatgtccgctaccggaacgacgctgacacacggattgaccaattcggatctgctggagtatgaaattaaaaagaggatttcagaaaaagcaaaagaagtgtatctattggctgaccattctaaattcggaaaatcaacgcttctgacgtatgcaccgtttgacaggctgcattgcattgtgacctctcagccattagacgacgagtacacgcagtactgcaatgagcatcaaatcggcattcatctggcctaacgtttacaatagtgttgagagtctatcatccattttattctaggaggcagatcatgaaaaaagcgaagctcggaaaatcagacttgcaggtattccctatcggattaggaacaaatgctgtcggaggacataacctctacccgaacctaaatgaagaaaccggaaaagaattggtgcgcgaggcgatccgtaatggcgtgacaatgttagacaccgcttatatttacggaatcggccgttccgaagaattaattggtgaagtgctgcgtgaattcaaccgtgaagatgttgtcatcgcgacaaaagccgctcacagaaaacaaggcaatgactttgtctttgataattcaccagaatttcttaaaaaatcagttgatgaaagcctgaagcgcttgaataccgattatatcgatttgttctacattcacttccctgacgaacatacgcctaaggatgaagccgttaacgcgctgaatgagatgaagaaagccggaaaaatccgttccatcggtgtatccaacttctctttagagcaattgaaagaagcaaacaaagacggtttggtagatgtattgcaaggcgaatacaacctgttaaaccgtgaagcagaaaaaacattcttcccgtatacgaaggagcataatatttcatttatcccttacttccctctcgtatcaggtttattggcaggaaagtatacagaagatacaacgttcccagaaggcgacctgcgaaacgaacaggaacacttcaagggcgagcgtttcaaagaaaatatcagaaaggtcaacaagcttgcgccgattgccgaaaaacacaacgtggatatccctcacatcgtattggcctggtatttagcaagaccggaaattgatattttaatcccgggagcaaaacgtgccgatcagctgattgataacatcaaaacagccgacgtgacgctttctcaagaggatatttcatttattgataagctgttcgcataagaagaaaacagccttctccattggagaaggctgtttttttgtgcgataaattcctaaataactgattttgaagcaaaaccttacaaaatgagccataaatccgataaaataaaggtagtttatctcagaaagaaagtgattgagaaagcaaaagtatgaaacgttcatatcatccagttcatatgaaataaagctgacccagcttcttttatttgctggtcagaatagcggaccgtttcgatggtctatggaggaaacagaatgaaacttaaatatgtaaaagccttagttgcagtaaccgttgctttaggtgtactgctgccatcaacgatttctcatgcaaagagcttcagcggccgctcatcatctagttacagcagccgaagttcaagctcgtcatacagcggaagctataaatcaagcccgaaatcaagctacagctcaggatcaagctcttctagcaaaaaatccaagacgcctgacgattcatcatcatcgatttcgcttaaaaagaagccttcggaaaaggcaagctcatcaagctctaaaaaatcgtcaggcaccttttccggcgctacatcaaaagtaaccggaaagacatacagcggaaaaacgtctaaagcttatgttggcggacgatatgtttcagtcaatcattactatcacgcaggtttcgcaccatcaggatggtttggatattatagcggatttacaatgggtatgttcatgatcagcatgatgcacccgtggggttacacctatcatccagccggaggccccggctatgtttcttatggcgcttcacccattgcctggatcgtggatatcatcgctttaatcattattttaatcattgtcatcgcgttgattcgcgcatttaaagcaccgaagacgtatagaaggagattttaggcaatgagattaatattaaatgagcaagaaatggtagacggaatttgcgtgtatatttccaatgaagaagatatctaccctgaagacgttgaagtaaaggagctatcttataacaagcgtacagggttcttcgctgaagctacatttggcctgcaccacaagcagcttatgtcagatgacatttcagaaggcattattcagttcttagaggaataccacaacttcaatccggaagttaccgtcgttgaattgcaatttgataagaaaaaaggcttctctgccttggttttcgtcaacgaagcagaagaataaaaatgtcttaatcaaaaccttactccgcgcgggtaaggtttttttaatggtttctctgagcataaagttatttcgtttttcctaaactcagcggatctgtgatcatctcttttggctttaacgtttccgtttgttcaaaacaaatgtttcaaatgagataggaaatgggtactaatctattaactttgttatacattttagatactcattggctcaacaactgaggaggagacatttgtgaagaaagacacaaggaaatatatgatctactttttcggcgctttagggggactgctatatggttacgatacaggtgttatctccggagcactcctgtttatcaataacgatattcctttaacgacattgacagaaggattggttgtcagcatgctgctccttggcgcgattttcggttctgccttgagcggcacatgctcagaccgctggggcaggagaaaggttgtatttgtcctttccatcatttttattatcggtgcgctcgcttgcgcattttctcaaacaatcggcatgctgattgcatctagggtgatactcgggttggccgtcggcggttcaacggcacttgtgcccgtatatctttcagaaatggcaccgacaaaaattcgcggtacactcggcacaatgaacaacttaatgatcgtcacaggaattttgctcgcctatatcgtgaactacctgttcacaccgtttgaagcgtggcgctggatggtcggtctggccgcggtgcctgccgtgcttttattaatcggcatcgcattcatgccggaatcgccaagatggctcgtgaagcgcggccgtgaagaagaagcgagacgaatcatgaacatcactcatgatcccaaagacatcgaaatggaattggcagagatgaagcaaggagaagcagagaaaaaagaaacaacactcagcgtcctaaaagccaaatggattcgccctatgcttctgattggcgtcggtcttgccatttttcagcaggctgtcggcattaacacggtcatctactacgcgccgaccatttttacgaaggccggtcttggcacgtcagcttccgcactcggcacaatgggaatcggcgtccttaacgtcatcatgtgtatcactgccatgattttaattgaccgtgtcggacgcaaaaaacttctgatctggggaagtgtcggcatcacactgagccttgctgctttatcaggcgtgctcctgacactggggctttccgcatcaacagcgtggatgacagtagtctttctcggtgtctatatcgtcttttaccaggcgacatggggtccggtagtgtgggtgctcatgcctgagctcttcccgtccaaagcacgcggagccgcgacagggttcacgactttggtgttatcggcagctaacctgatcgtgtcgcttgtcttcccgctgatgctaagcgcgatgggcatcgcatgggtctttatggttttctcagtcatttgtcttctctcatttttcttcgcgttctacatggtaccggaaaccaaagggaaaagcttggaggaaattgaagcaagcctgaaaaaacggtttaaaaagaagaaaagcacccaaaaccaagtgctgaatgagcgtacattataaaaaaaggaatcgtctccttatgagacgattcctttttctgtttacaccatgaccttgcaaatattgttcgtaaattccacagggtcctgaatcggcaggccttcgatgaggagcgcctgattgtacagaaggtttgtgtacaggctcagcttctctttatcttgttcaaacgtgtcctgcagtgtttggaatacctcgtgatttgggttgatttccagcactttttccgccttcacattttggctgtcaggcatcgcatttaagattttttccatctcaattgtcacttcgccgtcagcagcaaggcagactggatgtgatttaagccgttttgagattctgacgtttttcactttgtctgacagaatgtttttcatttcctcaaacagatccttatacttgctttcctcttcctcggactgcttttgatcctcatccgtgtctatgccaaggtctccgcttgatacggacttgaattctttttcctgataagaagccagcattttaattgcaaactcatcgatgtcctcagtaaagtagaggatttcatagcctttgtccgccaccatttccgtttgcggcagtttctcaatgcggtcgtaagaatcaccggtcgcgtaataaatgaatttctgctcctctggcattctggaaacatactcgtctaagctgaccagttttttctcttttgaagagtagaataagaggagatccttcaattgatccttattcgcgccaaaatcattgtacacgccgaatttcagctgtctgccgaacgacttgtagaacgtctcgtatttctcgcggtcttttttcaacaggctttgcagctcgcttttgattttcttgctgatgtttttcgcgatcagcttcagctggcggtcatgctgcagcatttctctggaaatattcagcgacagatcctcagaatcgaccatgcccttcacaaagctgaagtggtccggtagcaggtctgcgcacttattcatgatcagcacgccattggaatacagctccaagcctttctcatattccttggaatagtagtcgaacggcatgttttcagggacgaatagaattgcgttgtagcgaacggctccatccacactgatatgaacgtgtgtgagcggtttatcaaacccataatgcttttcagcatagaatttttcataatcctcatctgtcagctcgcttttgttttttctccagatcggcaccatgctgttgaccgtttgctcttcctgcacctcttcaaattcattttcgctgccttccttcggcttattaatggttgtatccattttgatcgggtagcgaatgaagtcggagtacttcttgatgatcgcttttaaacgatattcctctaaaaactcgtcatagctgtcatcttctgtgttctctttgattttcaggataatgtctgtaccgacagaatccttttcacacggttcaatcgtatagccgtctgcacccgcagactcccatttataagcctcttcgctgcccagcgctttactgatgactgtcacgacatcggcaaccataaatgccgcgtaaaaaccgacaccgaactgcccgataatgtcatgtccgtctttcagctcgttttcctttttaaacgcgagggaaccgctttttgcaattgttccaagatgctgttcaagctcatcctttgtcattccgatccccgtatcagagatggttaatgttctcgcatctttgtcagctgcgacctttatgtagtaactatctttatcaaacgtaagcgcatcgtccgtaagcgctttgtaatagattttgtcaatcgcatcactcgaattggagattaactcgcgcaggaaaatttctttttgggtataaatggagttaatcatcatatccaacaagcgtttagactctgctttaaactcttttttcgccactcttgatcgctcctttaccattatgtaaacccttttcagcatctatttatcacataagatgacaattgtcaattagattgatagatgcatatatatgtaaatttaacattagttggatttgttttcactctttttctcactcattctcataaaaaagagaggcttcatcatcctctctttttttctgtgtcattccagcggccaaactcccgcttcatccatatatgcaccgggtagaaaaacaaaccgaacggtatcaaaaacaaaagattatgccatgaagcattcagaaatgcgcttgcagtcaccggaaacgtaatctcttgcaataaaaaagagatgacagtcagcacaacaaatgcagatggaatggtaatgaagcaataaaacttgagctccttcttatgctgtaccttcaaacatacaaacctcccaacaatttctaattcatcttaacatatgctggcctttcttttctcgcatgtttatcactgcacatagcgggaagacaaatagaaaaaggaggtctcgtatcatgggaagacttgaaaacaaaacagcagtgatcacaggcgccgcgacaggcattgggcaagcgacggcagaggtttttgccaatgaaggcgcgcgtgtgatcatcggagatatcaataaagatcaaatggaagaaacagttgacgcaatcagaaaaaacgaaggacaggccgaatcctttcacctcgatgtgtcagatgaaaacagtgtgaaagcatttgctgatcaaatcaaggatgcatgcggaacgattgatattctgtttaataatgccggcgttgatcaggaaggcggaaaggtgcacgaatatccggttgacctgtttgaccgcattatcgctgtcgacctgcgcggcacattcctttgcagcaaatatctgattccgctcatgctcgaaaaaggaggctccatcatcaatacctcctccatgtcaggccgtgccgcggaccttgaccgctccggctacaacgcagcaaaaggcggcatcaccaacctgacaaaagcgatggcgatcgactacgcacggaacggcatccgcgtcaattccatttcaccgggtacgatcgaaaccccgctgattgacaaattagcaggcaccaaagaacaggaaatgggtgaaaaattccgcgaagccaacaaatgggtcacgccgctcggccgcctcggccagccgaaggaaatggcgacagtggccctgttcctcgcgtcagacgacagctcatacgtcacaggagaggacatcaccgcagacggcggcatcatggcatacacatggccagggaaaatgctgattgatgagaaatggaagaaagaaacgaaataagagaggggatgtccctctctttttgtctttcaaagcaatacaaccttatactttttcacatccaaaaactgcaaaaattccctcgccagcacttcaggcggatgcgcctttccttcatccagccgatacaaaagcaacccaataatcattgcggatacataatgggcataaagctttttctctgcgtgaatatcagtttgctgatgcagataaaacgattccagcgctttgaacatatcaggtatcacatgaggaacaccccattcccgattgagaaaatggacaatgggcatgtttgacaaagcagaaagcagactggcgagcgccttctccgcttcctttaaggaaaattcattcgggctggaggcaatcgtcaggtgatcaatgatctccgcacatgatcgctgtatcatggtttggagcaattcctccttattggcatagtgatcataaaaggttgcacggcggatattgcttttccgggtaatatccgaaatcgtgatggctgcgtagtcttttttctccgccagcacgtccagaaatgccttctggagcgcctctctcgttcgaaccacacgcctgtcgatttgcttgttcttctctcgctctcctggcacagcttgtccaaacagccaataaaatctcttttgagaaacaagctcccataccttttggctgatagcttccggagtcgcggccgcatcctcattcagccaatacaggataatcgcgtacgtgtacaaggcccggtaatgtccgtaaatttcccgttcgatcggcgtcaaattcacatggaccggagtcagcagaacatcctgctgaaacacatccctaaaaaaacgatggaaatgccctctgttcatcatcacagaaaaaaaggatcgatgctcatgaacaaaggacagcgtcggatgcaccgtttgccgttttttgttcaaatgaagggtatccatatgactgaaggcgtcaaaaagcgctttgcccagtccttccttcatgtcttcgatcacatcctcaatgattgaaaacttatcctcataataaaggtagagcgatccgcggctcactttggccttctcagcgatttctttcattgtgatgtgttgaatatctctatctttcaataaggccagcaacgcctctttcacttgagcttcggcagattccggcacaaaagacacccccaatcattagacagatcttcgatatatgtacggtaacgtatagatggttcaccgttgtctttcttacagaaaaggtaccaccttataataggtccgagaaaagaagaaagcaaatgagggggattttacaatggaacagcaagtaaaggacgacatccagcgtgtctttcagcttcagaaaaaacagcaaaaagccttgcgcgcttcaacagcggaacagcggagagaaaagcttcaacgctttttagattccgtcatcgcccatgaagaagaaatcatcgaagcgatccgcaaagacgtccgcaaaccatatcacgaagtcaaaaaagcggaaatcgaaggaacaaaaaaagcgattagagataatatgaataacctggaacaatggatggcgcctaaagaagtcggttcatcgttaagccctgacgcaaacggaattcttatgtacgagcctaaaggcgtcacactcatcctcggcccgtggaactatccgtttatgctgacgatggcgccgcttgccgcttctctcgcagccggaaacagcgcgattgtgaagctgtccgatttcacgatgaacacgagcaacattgccgctaaagtaataagagacgcttttgatgaaaaagaagtcgcgatttttgaaggagaggttgaggtggcaaccgaactacttgatcagccgttcgaccatattttcttcactggaagcacaaatgtcgggaaaatcgtcatgacagcggctgccaaacacttggcatctgtcacacttgagcttggcggcaagagcccgacgattattgacagtgaatacgatctgatggacgcagcgaaaaagatcgccatcgggaaattcgtaaacgccggccaaacctgcatcgcacctgattacctgttcattaaaaaagacgttcaggacaggttcgcggggattttacaaacagtcgtcaacgctggatttatggaggatgatcacaacccagaccgcagcaaatttacgcagatcgtcaatgaccgcaacttcaaccgcgtcaaagatctgttcgacgatgccatcgaaaaaggggcggaagtggtgttcggcggcgtatttgatgccagcgaccgcacgatctcgccaaccgttttgaaaaacgtcacgcctgacatgaaaatcatgcaggaggaaatcttcgcaccgattctgccaatgatgaactatgaagacatcgacgaggtcatcgattacgtaaatgaccgcgataaaccgcttgcactttatgtgttcagcaaaaaccaagacctgattgacaacgtccttcagcacacgacatcaggaaatgcggccatcaatgatgtcgtcgtccatttcagtgacgtcaacctgccattcggcggcgtcaacacaagcggaatcggctcctatcatggggtatacggattcaaagagttttctcatgagaagggtgtatttattcaggccgctgaataatcgcatgatcaaaaggcgcttccttagaggagcgccttttattgtaactccttgaccaaaagcaattcatcacggataggtattttattatctgccagtaaaggaatttcgggcttcatctttctggccgtctcgactgcattcacaaatagtcgatccaaccggtaccctctcttctgataaaacgctaatgcatgaatattatcattggttgtgatcagttttatttgtttgatatttctctctctgcatgcttcctcggctttctctagcagagctgttccgatccctttattctcaatgacactatccagcgaaatgatttcacaggcatcttcttcaaatatgtatgtaataaggccaacaatctggttatcatcgttgagcattccataaccatctaattcatcgcagttataaataccgctagaaataaccatttgcggactgccccagtgtttttgaaaaaacgcggaaacaagatctttaggtatctggcatgtcggaataatattcatattttcctccttttaactgaacaaaaataagagaattaacaacctattttatgtcattaatccccttatctagtatttactagaacttataacttgtcaaaagctgtctgaataccaattgcgtggattgataaggatcaaaatctgaatcctgagattggaagatttgctctggggtcaatgtctctgcgttctctgataacgtttgaatcagactttccaaatatccatttaactctgatttggacgattcatgtagggattgatgatttacagcgagttctctaaatctgttatcactgattaatttttttcgaagagctgctagcatcaagtcaagccatgcaggctggccaaatgtaatatttaaagctaacgttgcttgatcagatttggtggagtgccataaacctcttggcaaatacagcatggttcccggtgttaaattaacgatttctgcatctggcagatcctcttttggcggatctcctttccaatatgactgtaaatcatcaggatagtaaggagcctctgataaatcatagtgctgcattggattgctcacattttcattcttggcaagcttccatgttttctcaccttgaatttgaaaaatcaagttggtgtaggcgtcaaaatgggctttgaatcccccgccatttttcgccgcgtaaacaatggctttggaagaagtacccgcaggcagtcttaattccgctttgagtttttctatccaccttctgacttggggaataaataggtcggtgaaatcaaactctaatgcagcccctttttcataccactctaaagcctctgcaggtgacacaagaaatctgtctgtgatcccttcagattcttcaatcacagcatcaccaacgaccatgactggattattgtagatagccaatacgttttctagcgttctaaccttttcaaaccccggtatgcttgtaaatctctccacttctcctctggctaccaaaggttttacaggccaatattcttctaaaaactcactcatcgttacaggactgatgatagactccaaaaccgattcggttacagcactcatattatccctcccaaaaaaagtaacttcaccacaaagatataacatttttttctaaaagtaaatattgacagaattatcagaggattataatatttagttgtgcgtgatagcctatttttttacaaggaaggagggaaaaggatgaaaaaggcttataagaaacctcgtctttttgaactgcgccgtgctgtagcagctggcggccattaatctcatatagcatttgacatctagtactctattttaggagggatgctcaatgaaaaaagcttataagaaacctcgcctttttgaattgcgccgcgctgtagcagctggcggtcattaatcttatccaaaacgattaacgtttgaggctatcacgccaacttgataaggaggatgctgaagatgattacggctgaagaatgcagaacgtacaaagaatttgttgatctttaccaatcctatctttaccccttgcttggcgccagactgtcccggatgtattcccccaaaaacaaagtcattatcgatatgggcacaggtccaggttatttaagcattcagttggctaaaagaacaaatgcgcacgtgcatgctgtcgatattaacccggccatgcatgaaatcgctcaagaagaagctaaaaaaagcggagtaagcagcctgatttcatttgatttggaagatgtccaccatttatcttacgctgaccaatatgctgacttcatcgtctcctactcttgcctgcatcattgggaagacgttgttaaaggacttaaagagtgctatagagttctggctccgggcggaaaaattgtcattttggatacatttaatccccaaggaagccatttagagattatgcgaaaacaaatcaaagaaccggaatacttcaggtttgtaagagaggcatttgaagaaagttattcctttgaagacattcaccagtttgttcaggatgccggcattcccaattattcattagaaacctttcactttttaccggaggattttatagaaagcttagatgagctggaggatgctcccctgtgggaacaaaatgatcaaagtgctgatcatgaaattgagtctgtcacatggatgttaacgatagaaaaagaaaaggaaggtgcattgtaatgatcaatgaatcaactgttttatccaaaaatccagaaatgccatcaagaaaatatttgaaaagcattattatagagccgggcatcactttaaatgaaatggcatcagatatttataaccatatcgacggcaaggtcagcatacatgatatttgctcaaaaatcgtcaatgaatatgatgttgattatcaaacctgcttagaagattgtatggagctgtttgagttgcttattgatcatgaagcaatcaaagttaagcagggggcatgagaattggaaaaacaaaaagtgcttgctttaccagacgatgtacatgagctgagtacacaccgttctaaatcaatcgtaaattacatcatcactctgcttgcctttgccaaaaaacaaggattgactcatcaagatattgtaagctggattcacgagcaatatgaggaaagaggatattatgatgagtggagacacattaacagccaacaaccagttggatcatttgtggaactctttataaaaggaagacgtttactttatgacaaaattgaattgtttgaaacagaagataaatatgtcgtaaatacccacacttggtatgaaaaagaacctagtgaggcctttttttattttgaaattgatcccgaagaattttctgcgtacgcttccattctcgcaatcgaaaacgcaaaacgtctcggaattaaaatcgatattgtaaaagaaacagatgtagagacagcttatatctataaacatcaataacgctattgggagggagacatatgtgcgggctcgcgggtattataaatctggctgctccccgttctcaggaatgtacctttcatatattgaaaggcatggcagatgccatcagctataggggaccggatgatgaacaatatcatattgattccaaagtcggctttgcatttcggcgattgtccattcttgaccttgtaaatggacagcagccctttttaaatgaggatggatcaatcgtcgttatggtaaatggagaaatttataactataaagaactgaaggcatctttacacaatcatatgtttaaaacgacatctgattgtgaagtaattgttcatttatatgaagaaaaagggattggatttgtagacgacatcatcggaatgttttcaatagccatttgggacaaaaataaaaacaaagtatttttagttcgtgaccgctttgggattaaaccgcttttttacacagagctaaaacacgagcttatatttgcctctgaaataaaatccctattttctcatcctcactgtccccgccaatttaattggaaagaagcactctcagacatttggctaagcggggaagcagccagtaatcataaagaaaccacttccttttttgtaaacatccaaaatctcgatgctggccattatctcgaaattaatttgacaacaaatgaacgaaaaacagcaagctattggtctttacaggatattttgctcaggcaaggctatcatgagaatctccatcccgatgacctgattgaaggatatagagaactgctggcagattcagtccatagatgtttacaaagcgacgttgaagtcgggttgtttcttagcggtggcattgattcagctgcagtcgcacattttgctgcagaaaaacaggatctccatacgtttacagtattaagccaaagtacatttacaaatgaagatgcaaaatatgcccattggctggctaaagatttacaccttccaaatcatcaggttctctatcaattagggaacgatgagttattacaaccagagtcatataaacatttgttatggatctgtgaaacaccgttttgcggaccggaacaattatataagtttcatttacataagtatgccaaagcgataaggccaaacctgaaagtcatgctgaccggccagggcagcgacgaatttaacggcggttacagcacgacactttcaccagccgagaacccaagttgggaaggatttattgaatcggtcaatacgatggagatgaaccggctgcatcggctgcagggaaatatctttagagtgtgggaggagcattttggactttctcctataaacctttcttatttaaagagcaatgattccagccaagcagatccttggcaatcgtatgtcctgacaaaataccgtgatctgcaaatgtataattgctggcatgaagatcggatcgccgcggctaatcatatcgaaaaccgtgtaccgttcttggaccatcggcttgttgaatgggtttgcggaatacctgatggactccgtaaagacttgttatgggataagtcggtattgcgaaaatcattaacaaatgagctgcatacaagctatacccaccggccaaaggttccttttttctatggtaaggacgtgagatatacacataaaatgatgtttcatcttctgaagaaaaacaattatcagcttatagaggaggccttctctcacagcgatgcctccagcataatacaggttgaacacattcatgccatcatgacatatttggaggatgatcctgagtttacaaattttgaatttttattaagactggtgaacatgggacttttatcaaaaatgactaaagaaaccccttctgttcaattagacataaccagccatttagaatcgataacaataaaagactggcactcacaggaaggtgatattgccagtcgtttaaatatctcagccaataagtgtgaaggacaagatattttggcgctaaaccctggcgtcactctgttaaggccggaaagcgatagtgagcattgcatctacattgcggaagaaggatttattcagtttattgtttcggaggaagacgtcggagcttggctgcatattctctgcgatattaatggaaaagacacacttcatacgattttagacagacatggtgtcagccttgaagaagtggccaaatatattcaagaagccatcgaacacaatatcattttgatcaaacaaaaaaatctgccagaaggagcatatagatgagcatcttttattcgttttccgcacttaggggattagcaatggggattttttcgcctatttggattctttatctgatatctaaagattatgatttccttcagattggattaatgggagcagtacttgaaattgctaagcttatatttgaagttccttccggcgtttttgctgatcgttatggaattaaaatttcaattgccagttcattctttttctccatccttacatgggccttcttcccttttatcgattcagctgctatttgcatactggctatgatcatatgggctttatcagattccttaatttccggttcttttgaaacttggatgagccgtgtcgcaggggaagatcgattcggcaaagaaatgatgaaaaacacacaattgctaatcacttttttaattattggaagtattgccagcgggtatttgtattcattaaatatctattttcctttcctgctcgttatggtgatctacttattactatttatttggatgtctgtatttattaaagtcccttctgtttccgaaacaaatcatggggatcagaaccaacatgattcgataaagattatcaaagaaagtttaaaaattatctttaacaaaaaaagggttcttttaatcgtcatagccggtttctttacagccacagcctatgacacaatttcccgttactggcagccttttttgagtgatttaggcttttcagaaaagtcactgggatatatttttgccctaggagggtttaccgctctcgttcttttgacattaaccatcaggttcgaaaagaagatcgaaaaaaatccatatctcgctttaacctcattggattccatgggcatggtcatgacttttctattgtctagagcattcaggccgctgggcattccatgtacagcgtttttgcttgcaattgaagatattcatcatccgatcgtaacaagttacttaaataagtttttccccgattcatacaagaacacacttttctcgttaaactcaggggtaggagcaattggagaaattctttccggtgtcattttcggcatcatttccgcagcctttgggctctctgccatgtttgttgttgtagctgtatttctattaatccctattatcctttatacgatagtgcctaagattaaagacaatgatatgaaagttcagattgaaaaatcccagcaagtgtaaatgttttgtatcacagtaagaagaccttcttattaaaagaaggtcttctgctattctattcagttatttcccaaaagccatcagcttcgtataacttccaatataaagcgttccgtcctcagcgagctgaggagatgacacgacgttgctgtcggtttgatagctccataattcattgccgtttgcgtctgccgcataaaccttcatatcatctgacccgaaatacaccgttcccttcgcgtcaatcagcggcgccgttctgacagggccgtctgtatagaatgaccagttcatatctccgtttttgctgatggaaaacagctcgccgcttcctgagccgatgtagatattgccattatgatcaatcgcaggagatgagctggagaacccgtttaacgggaatgtccatttcaaactgcctgttgatgtataagcatacagctgtccatcttggttgccggcataaatgtttccgtccttatcaatcaccggatatcctttaaacgcatttgacgtcgttctggaccatttcacctgtccggttccggagttgatcgcataaaacacgtaattatatgtgccgacatacacggtgccgtttttggcaagcaccggcacagagctgacgacaccatttgttttcaacttccagcgctctgtccaggttgattttgacgtcggtttgatcgcgtgaacataattatcaagtgttgagaaatacaacgtcccgtctgaaccgatcaccgtttcagagcttggcccgccgcttaacggaaccgttgttaaaatttctcccgtttctttgtcaataaaataaatctttttgtcataggatgccaaatagataacgccgttggtcccaagtacaggagattgcgtatatgtttttccaagattgcccgtcacccatttgactgagccgtctggattaaaggctttcatttccccgtctctggaatgaagatatactgtgccgtctccgtcaatcacagcccccgctccattttgcggagtcgttctgatgtcgttttgccatttcagcgtcccgtctgtatttccggcgaaccggctttcgcgtgaccagttaaacatggcaggtgccatcgcttgtacatcatatcttcctgtcaaaaagccagatgctccattattttgagaaaataccgtttccgccgcataagcagctgtcggctgaaacactttggcagcgggcacatcagaaacagcaccggccgaaacagccgccgccaccgcagctcccgcaatcaaagctttcatacgaaatgacttgaccatcattgagacccccattatatgtaacttctaatttgtgaccatcataacatattcatccattttataaatctatttcacaaaaacatcacaaactagaaaactatgtaagagtattcacggacgttttttcagcacccggccgaaatgcagccacaaaccaaatgacgttgacagcagccgcagcgagactaattccgaaaacaaagatcaccttagaaagcagatggtcactaaagaaactaaacatcaagataaaaccggccgaagacaaatgaatcaaaagcccgaagccgcaaagcaccgccatgacatacctcattgcatcgactccgagcatataaacgagaaatggaatgaaatacaatacaaggatcataccgacagctgaccacatgccaaccgaattaaactgattggccgccgctcccgttccggccagcggcgaaagtgaagccgccacaatcacggcgcaaaaaagaaacgcagaaatggttgtcatgatcgccacgctattttttttagacatcaaactcctcctttaatagaaatattaaccttttttattataagtaagttgaaagttatattcattatattttttaaaaaaatccagaacgtacagaaatgatgtgattctttctagtatatttatatagtaaaaaacaaaggataaaagactcatttttctgtaatatcaggattttatcaccataccatattgcatgtacttctttttcaaagtatactattccagattaattcagaggagagagaaaaatacatggaaaaaccagcaggattttggattcgttttttagcttattttattgatggcattattgtatctgttcctagttatattattctatttgtgatcaattctgtttttgtagctggggctgtggcaacaaacccttacatgacggaagaagagtatttagtaaaatacatgacgcttgcatttttgcctactatgctgatcatgatcgtcatcagtgtgttatattacgggctgctcacagcttctaaaatgcaaggcacacttggcaaaaaaattcttggcctgaaagtggtcaatgaacaaggcgaacgggtttctgtcggacaggcaattggccgttactttgcctatatcttatctggaatcatcttttatatcgggtttatcatgatcgcctttggagagaaaaaaggcctgcatgacatcatttgcaaaacacgtgtcgtgtataaataatagaaaaaagtctagacgccaataggcatctagacttttgttttctttacaataggctgccacgacagatacgtagcgcttctccacagccactcaaacggccccatccgaaagacacgaagccaaaggtggctgaagaccatttgaacggcacaaacagcaattgtaatgagcacaccggcagcagggtacacttttccatacaggcccaagccgtaatgataaaaaatccaagtacatacaatagactgcatcagataattggtaaatgccatcctcccaacagcggagaatgattgcagcactgttctcactcttgttttatgataaagatagacaaccgttgtaacatagaaaaacatgaggaaaggcgcgccaatcagcaaacatatttctttatccgttacactgtacagcacctgggcgccgatgccgatgacaagcccagccatccacaatcgttttaatcctttgcgatgcttttctggttcatgcaagtaccgagatttcgctgccgcagctcccagcaaaaacatgctgaaatatggaatggatgcaaagaagaagttgagcggattatacgtaagcatgccattcgaagacatataaacaagacggtcatggatccgctgttctgcaatgtccttcaggctgccgcttccataaacatgaatcgcttgttttgcctgctgttttaccgcttgtacccattcctgtccgtttgattgatcaaaacttgtcaacatgaacggaatggaaaacaaaagatacaaagagaccgcccatatcagcagtgttttcggctttgcttttcgaaacaagagcaggacaaaaccgagcagggcatattctgttaaaatatctccgtcccatatcaaaaaggcatgaatcgttccaaacaagagaagcgccattaaccttctcacatataacggaacaaaccgtttccctttgttttctgctctctccatcatgacaaccatgccaaatccaaataaaaaggaaaacaataaaatacattttatttgaatgaagaatttcagtatatctgcggcggcaaaatcagcttcagaccacttatccatgaaaaaattctcttttccaagcatagacaaatacatatccggataactgaaatgtgccagattgacaaataagatgccgaaaatcgccattcctctcagcacatcaagcacaccgatccgctcatttgttaaagtcggctgtaatgaagacatagccatcacgctccttttttctgtaccttaagggtatgaaaaaatgaagcgcggaaacatcgatttaggtgtcaggccggcatgaaaaccttacaatcttgtcatctttatggtttcatcacctttaaatctaatgcttcgatattctgcaaaacgcgatcaaagcgcaaagcctgaggctcacatgggaagatgtggccttcatacgggtcgcctaacgtccggaaaaacggttcaaataaaccaggaaccaatacgcccaccatctttgtatagtaagaatcaaggcgataggagtgaacggtatttgcagggacatgcaggaaatctcccggattcagctgaatttcctggccatctgcccacatcgtcatctgaccttcaaggcaataaaatgtttctgtatgatgttcatggtagtgatcaacgattcggtcacctttagggccttcagaggatacgacgataaactggccatctgtatttttttgtgcagccacaatgcggtgaagctgatctccagtcaacaggtgatctccttctccagattcaagaacgtatggaaccgctccatctggcagctctgtaagttccgctaatttggccgaacatgcaggctttccttcatctagaaatacaatgtccgctacagcggctgcttctgcaaatcgctcgtttgagacttcttcgcttgcgtacggcggatgttcagcgtgatcatacggattcccaataacggaatacaagtgcgctacgtttcctttcatcgtgtaagataccagtcttgttctgtggctctgcatccggtagctgtgcggtgttcccgccggaatgttcgcataatcacctgatattaataaatagcgttcaccatcaagtgtcagttccagtttcccgtccaaaacgagaattccttcatgtgtgtccttgtggacgtgaagcggaaaggcatctccttttcccccggaaagaagcacgatctcaaacaaatcacctgtgctcctcccattcgccatcaccgtggcaacctgtctgccgaacagatagcgctcgccttctccgctccggagcaaataaggcattttttctttaggcaatgaatgtgtacataatgttttcatattatcgcttcctccaatttagaccagtctatatattatcatttatttgtctagaccgttctatataattgtaggagaaaggataacaaaatgctaccctttttttctcaccagcactggtatttgttcggcaatgagaagaagaggcgttttgtctttattcgttaacgaaagcatgatgccgccctcaatcatcgaattaatcagcgttccaagctgatttgcttcttcatctgcaaatccgttttccattaattttctggcaaaaaccgcttcccagcttttaaacaccttcatgcaaaccgtccgcagcggttcactgattaacgctgtctcactcgccagcaaaccgactggaatacctttaatgctttctgtgttatcaaattggctggctgtttttttgataaaaagctgaatcgcttcaacaggatcagaggattcatccatgctttgctgtatcagatgttcaacgatcttacctgtatatgtaaccgcttcaattgctaattcttctttgccattcggaaaaaagtgataaagcgatcccttaggagcaccgctttcttttacaatctggttcaaacctgtcgcgtgatatccttgcagctggaacagacgtgacgccgtgtgaaggattttttcacgtgaatctcctctgctagtcattaaaacattccctcctaggtatggtagagcgacttatataatataaaaaagaaccctgtgattgtcaaaaggggtaagacccttccggatggggtaatgtacaaaaacagcgtctaggagggatctctcaatg
